(12) United States Patent
Hershey et al.

(10) Patent No.: US 7,589,257 B2
(45) Date of Patent: Sep. 15, 2009

(54) GENES FOR ENHANCING NITROGEN UTILIZATION EFFICIENCY IN CROP PLANTS

(75) Inventors: Howard P. Hershey, Cumming, IA (US); Carl R. Simmons, Des Moines, IA (US); Dale Loussaert, Clive, IA (US)

(73) Assignee: Pioneer Hi-Bred International Inc., Johnston, IA (US)

( * ) Notice: Subject to any disclaimer, the term of this patent is extended or adjusted under 35 U.S.C. 154(b) by 0 days.

(21) Appl. No.: 11/668,514

(22) Filed: Jan. 30, 2007

(65) Prior Publication Data
US 2007/0300323 A1 Dec. 27, 2007

Related U.S. Application Data

(60) Provisional application No. 60/771,906, filed on Feb. 9, 2006.

(51) Int. Cl.
*A01H 1/00* (2006.01)
*C07H 21/04* (2006.01)
*C07K 14/415* (2006.01)
*C12N 15/00* (2006.01)

(52) U.S. Cl. .......................... 800/295; 438/6; 438/468; 438/419; 438/320.1; 438/183; 530/370; 536/23.1; 536/23.6; 800/278

(58) Field of Classification Search .................. None
See application file for complete search history.

(56) References Cited

U.S. PATENT DOCUMENTS

2004/0034888 A1* 2/2004 Liu et al. .................... 800/289

FOREIGN PATENT DOCUMENTS

WO 9509911 A1 4/1995
WO 2004058980 A2 7/2004

OTHER PUBLICATIONS

Lintala et al. (The Plant Journal, 49:1041-1052, 2007).*
Rodriguez et al. (Plant Physiol., 143:639-649, 2007).*
Wells (Biochemistry 29:8509-8517, 1990).*
Ngo et al., (The Protein Folding Problem and Tertiary Structure Prediction, K. Merz., and S. Le Grand (eds.) pp. 492-495,1994).*
Guo et al. (PNAS, 101: 9205-9210, 2004).*
Keskin et al. (Protein Science, 13:1043-1055, 2004).*
Thornton et al. (Nature structural Biology, structural genomics supplement, Nov. 2000).*
Gallais, A., et al.; "An approach to the genetics of nitrogen use efficiency in maize"; Journal of Experimental Botany (Feb. 2004) 55(396)295-306; Society for Experimental Biology; Southampton, UK.
Presterl, T., et al.; "Improving Nitrogen-Use Efficiency in European Maize: Estimation of Quantitative Genetic Parameters"; Crop Science (2003) 43:1259-1265; American Society of Agronomy; Madison, WI, US.
Seebauer, J., et al.; "Amino Acid Metabolism in Maize Earshoots. Implications for Assimilate Preconditioning and Nitrogen Signaling"; Plant Physiology (Dec. 2004) 136:4326-4334; American Society of Plant Biologists; Rockville, MD US.
Barthes, L., et al.; "Xylem exudation is related to nitrate assimilation pathway in detopped maize seedlings: use of nitrate reductase and glutamine synthetase inhibitors as tools"; Journal of Experimental Botany (Apr. 1996) 47 (297):485-495; Society for Experimental Biology; Southampton, UK.
Good, A., et al.; "Can less yield more? Is reducing nutrient input into the environment compatible with maintaining crop production?"; Trends in Plant Science (Dec. 2004) 9(12):1360-1385; Elsevier Ltd; Oxford, UK.
XP-002448338; Database Geneseq Accession No. AD082497; Apr. 21, 2005; "Plant Full Length Insert Polynucleotide Seq ID 1217".
XP-002448339; Database Geneseq Accession No. ABM90089; Jun. 2, 2005; "Rice abiotic stress responsive polypeptide SEQ ID No: 8426".
XP-023022; Database Geneseq Accession No. AY023022; Feb. 9, 2001; "Oryza sativa microsatellite MRG5347 containing (GAA)X9, closest to marker RM154, genomic sequence".

* cited by examiner

*Primary Examiner*—Phuong T Bui

(57) ABSTRACT

The invention provides isolated NUE (nitrogen utilization efficiency) nucleic acids and their encoded proteins. The present invention provides methods and compositions relating to altering nitrogen utilization and/or uptake in plants. The invention further provides recombinant expression cassettes, host cells, and transgenic plants.

17 Claims, No Drawings

GENES FOR ENHANCING NITROGEN UTILIZATION EFFICIENCY IN CROP PLANTS

CROSS REFERENCE

This utility application claims the benefit U.S. Provisional Application No. 60/771,906, filed Feb. 9, 2006, which is incorporated herein by reference.

FIELD OF THE INVENTION

The invention relates generally to the field of molecular biology.

BACKGROUND OF THE INVENTION

The domestication of many plants has correlated with dramatic increases in yield. Most phenotypic variation occurring in natural populations is continuous and is effected by multiple gene influences. The identification of specific genes responsible for the dramatic differences in yield, in domesticated plants, has become an important focus of agricultural research.

One group of genes effecting yield are the nitrogen utilization efficiency (NUE) genes. These genes have utility for improving the use of nitrogen in crop plants, especially maize. The genes can be used to alter the genetic composition of the plants rendering them more productive with current fertilizer application standards, or maintaining their productive rates with significantly reduced fertilizer input. Increased nitrogen use efficiency can result from enhanced uptake and assimilation of nitrogen fertilizer and/or the subsequent remobilization and reutilization of accumulated nitrogen reserves. Plants containing these genes can therefore be used for the enhancement of yield. Improving the nitrogen use efficiency in corn would increase corn harvestable yield per unit of input nitrogen fertilizer, both in developing nations where access to nitrogen fertilizer is limited and in developed nations were the level of nitrogen use remains high. Nitrogen utilization improvement also allows decreases in on-farm input costs, decreased use and dependence on the non-renewable energy sources required for nitrogen fertilizer production, and decreases the environmental impact of nitrogen fertilizer manufacturing and agricultural use.

SUMMARY OF THE INVENTION

The present invention provides polynucleotides, related polypeptides and all conservatively modified variants of the present NUE sequences. The invention provides sequences for the NUE genes.

The present invention presents methods to alter the genetic composition of crop plants, especially maize, so that such crops can be more productive with lo current fertilizer applications and/or as productive with significantly reduced fertilizer input. The utility of this class of invention is then both yield enhancement and reduced fertilizer costs with corresponding reduced impact to the environment. The genetic enhancement of the crop plant's intrinsic genetics in order to enhance nitrogen use efficiency has not been achieved by scientists in the past in any commercially viable sense. This invention uniquely uses a highly selected set of maize plants that has been shown to differ in aspects of nitrogen utilization. The plants were then subjected to experiments in mRNA profiling and data analysis to yield a set of genes that are useful for modification of crop plants, especially maize for enhancing nitrogen use efficiency.

Therefore, in one aspect, the present invention relates to an isolated nucleic acid comprising an isolated polynucleotide sequence encoding an NUE gene. One embodiment of the invention is an isolated polynucleotide comprising a nucleotide sequence selected from the group consisting of: (a) the nucleotide sequence comprising SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311 or 313 ; (b) the nucleotide sequence encoding an amino acid sequence comprising SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312 or 314; and (c) the nucleotide sequence comprising at least 70% sequence identity to SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311 or 313, wherein said polynucleotide encodes a polypeptide having enhanced nitrogen utilization efficiency activity.

Compositions of the invention include an isolated polypeptide comprising an amino acid sequence selected from the group consisting of: (a) the amino acid sequence comprising SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312 or 314 and (b) the amino acid sequence comprising at least 70% sequence identity to SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312 or 314, wherein said polypeptide has enhanced nitrogen utilization efficiency activity.

In another aspect, the present invention relates to a recombinant expression cassette comprising a nucleic acid as described. Additionally, the present invention relates to a vector containing the recombinant expression cassette. Further, the vector containing the recombinant expression cassette can facilitate the transcription and translation of the nucleic acid in a host cell. The present invention also relates to the host cells able to express the polynucleotide of the present invention. A number of host cells could be used, such as but not limited to, microbial, mammalian, plant, or insect.

In yet another embodiment, the present invention is directed to a transgenic plant or plant cells, containing the nucleic acids of the present invention. Preferred plants containing the polynucleotides of the present invention include but are not limited to maize, soybean, sunflower, sorghum, canola, wheat, alfalfa, cotton, rice, barley, tomato, and millet. In another embodiment, the transgenic plant is a maize plant or plant cells. Another embodiment is the transgenic seeds from the transgenic NUE polypeptide of the invention operably linked to a promoter that drives expression in the plant. The plants of the invention can have altered NUE as compared to a control plant. In some plants, the NUE is altered in a vegetative tissue, a reproductive tissue, or a vegetative tissue and a reproductive tissue. Plants of the invention can have at least one of the following phenotypes including but not limited to: increased root mass, increased root length, increased leaf size, increased ear size, increased seed size, increased endosperm size, alterations in the relative size of embryos and endosperms leading to changes in the relative levels of protein, oil, and/or starch in the seeds, absence of tassels, absence of functional pollen bearing tassels, or increased plant size.

Another embodiment of the invention would be plants that have been genetically modified at a genomic locus, wherein the genomic locus encodes a NUE polypeptide of the invention.

Methods for increasing the activity of NUE polypeptide in a plant are provided. The method can comprise introducing into the plant an NUE polynucleotide of the invention.

Methods for reducing or eliminating the level of NUE polypeptide in the plant are provided. The level or activity of the polypeptide could also be reduced or eliminated in specific tissues, causing alteration in plant growth rate. Reducing the level and/or activity of the NUE polypeptide may lead to smaller stature or slower growth of plants.

DETAILED DESCRIPTION OF THE INVENTION

Unless defined otherwise, all technical and scientific terms used herein have the same meaning as commonly understood by one of ordinary skill in the art to which this invention belongs. Unless mentioned otherwise, the techniques employed or contemplated herein are standard methodologies well known to one of ordinary skill in the art. The materials, methods and examples are illustrative only and not limiting. The following is presented by way of illustration and is not intended to limit the scope of the invention.

The present inventions now will be described more fully hereinafter with reference to the accompanying drawings, in which some, but not all embodiments of the invention are shown. Indeed, these inventions may be embodied in many different forms and should not be construed as limited to the embodiments set forth herein; rather, these embodiments are provided so that this disclosure will satisfy applicable legal requirements. Like numbers refer to like elements throughout.

Many modifications and other embodiments of the inventions set forth herein will come to mind to one skilled in the art to which these inventions pertain having the benefit of the teachings presented in the foregoing descriptions and the associated drawings. Therefore, it is to be understood that the inventions are not to be limited to the specific embodiments disclosed and that modifications and other embodiments are intended to be included within the scope of the appended claims. Although specific terms are employed herein, they are used in a generic and descriptive sense only and not for purposes of limitation.

The practice of the present invention will employ, unless otherwise indicated, conventional techniques of botany, microbiology, tissue culture, molecular biology, chemistry, biochemistry and recombinant DNA technology, which are within the skill of the art. Such techniques are explained fully in the literature. See, e.g., Langenheim and Thimann, (1982) *Botany: Plant Biology and Its Relation to Human Affairs*, John Wiley; *Cell Culture and Somatic Cell Genetics of Plants*, vol. 1, Vasil, ed. (1984); Stanier, et al., (1986) *The Microbial World*, $5^{th}$ ed., Prentice-Hall; Dhringra and Sinclair, (1985) *Basic Plant Pathology Methods*, CRC Press; Maniatis, et al., (1982) *Molecular Cloning: A Laboratory Manual; DNA Cloning*, vols. I and II, Glover, ed. (1985); *Oligonucleotide Synthesis*, Gait, ed. (1984); *Nucleic Acid Hybridization*, Hames and Higgins, eds. (1984); and the series *Methods in Enzymology*, Colowick and Kaplan, eds, Academic Press, Inc., San Diego, Calif.

Units, prefixes, and symbols may be denoted in their SI accepted form. Unless otherwise indicated, nucleic acids are written left to right in 5' to 3' orientation; amino acid sequences are written left to right in amino to carboxy orientation, respectively. Numeric ranges are inclusive of the numbers defining the range. Amino acids may be referred to herein by either their commonly known three letter symbols or by the one-letter symbols recommended by the IUPAC-IUB Biochemical Nomenclature Commission. Nucleotides, likewise, may be referred to by their commonly accepted single-letter codes. The terms defined below are more fully defined by reference to the specification as a whole.

In describing the present invention, the following terms will be employed, and are intended to be defined as indicated below.

By "microbe" is meant any microorganism (including both eukaryotic and prokaryotic microorganisms), such as fungi, yeast, bacteria, actinomycetes, algae and protozoa, as well as other unicellular structures.

By "amplified" is meant the construction of multiple copies of a nucleic acid sequence or multiple copies complementary to the nucleic acid sequence using at least one of the nucleic acid sequences as a template. Amplification systems include the polymerase chain reaction (PCR) system, ligase chain reaction (LCR) system, nucleic acid sequence based amplification (NASBA, Cangene, Mississauga, Ontario), Q-Beta Replicase systems, transcription-based amplification system (TAS), and strand displacement amplification (SDA). See, e.g., *Diagnostic Molecular Microbiology: Principles and Applications*, Persing, et al., eds., American Society for Microbiology, Washington, D.C. (1993). The product of amplification is termed an amplicon.

The term "conservatively modified variants" applies to both amino acid and nucleic acid sequences. With respect to particular nucleic acid sequences, conservatively modified variants refer to those nucleic acids that encode identical or conservatively modified variants of the amino acid sequences. Because of the degeneracy of the genetic code, a large number of functionally identical nucleic acids encode any given protein. For instance, the codons GCA, GCC, GCG and GCU all encode the amino acid alanine. Thus, at every position where an alanine is specified by a codon, the codon can be altered to any of the corresponding codons described without altering the encoded polypeptide. Such nucleic acid variations are "silent variations" and represent one species of conservatively modified variation. Every nucleic acid sequence herein that encodes a polypeptide also describes every possible silent variation of the nucleic acid. One of ordinary skill will recognize that each codon in a nucleic acid (except AUG, which is ordinarily the only codon for methionine; one exception is *Micrococcus rubens*, for which GTG is the methionine codon (Ishizuka, et al., (1993) *J. Gen. Microbiol.* 139:425-32) can be modified to yield a functionally identical molecule. Accordingly, each silent variation of a nucleic acid, which encodes a polypeptide of the present invention, is implicit in each described polypeptide sequence and incorporated herein by reference.

As to amino acid sequences, one of skill will recognize that individual substitutions, deletions or additions to a nucleic acid, peptide, polypeptide, or protein sequence which alters, adds or deletes a single amino acid or a small percentage of amino acids in the encoded sequence is a "conservatively modified variant" when the alteration results in the substitution of an amino acid with a chemically similar amino acid. Thus, any number of amino acid residues selected from the group of integers consisting of from 1 to 15 can be so altered. Thus, for example, 1, 2, 3, 4, 5, 7 or 10 alterations can be made. Conservatively modified variants typically provide similar biological activity as the unmodified polypeptide sequence from which they are derived. For example, substrate specificity, enzyme activity, or ligand/receptor binding is generally at least 30%, 40%, 50%, 60%, 70%, 80% or 90%, preferably 60-90% of the native protein for it's native substrate. Conservative substitution tables providing functionally similar amino acids are well known in the art.

The following six groups each contain amino acids that are conservative substitutions for one another:

1) Alanine (A), Serine (S), Threonine (T);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V); and
6) Phenylalanine (F), Tyrosine (Y), Tryptophan (W).

See also, Creighton, *Proteins*, W.H. Freeman and Co. (1984).

As used herein, "consisting essentially of" means the inclusion of additional sequences to an object polynucleotide where the additional sequences do not selectively hybridize, under stringent hybridization conditions, to the same cDNA as the polynucleotide and where the hybridization conditions include a wash step in 0.1×SSC and 0.1% sodium dodecyl sulfate at 65° C.

By "encoding" or "encoded," with respect to a specified nucleic acid, is meant comprising the information for translation into the specified protein. A nucleic acid encoding a protein may comprise non-translated sequences (e.g., introns) within translated regions of the nucleic acid, or may lack such intervening non-translated sequences (e.g., as in cDNA). The information by which a protein is encoded is specified by the use of codons. Typically, the amino acid sequence is encoded by the nucleic acid using the "universal" genetic code. However, variants of the universal code, such as is present in some plant, animal, and fungal mitochondria, the bacterium *Mycoplasma capricolum* (Yamao, et al., (1985) *Proc. Natl. Acad. Sci. USA* 82:2306-9), or the ciliate *Macronucleus*, may be used when the nucleic acid is expressed using these organisms.

When the nucleic acid is prepared or altered synthetically, advantage can be taken of known codon preferences of the intended host where the nucleic acid is to be expressed. For example, although nucleic acid sequences of the present invention may be expressed in both monocotyledonous and dicotyledonous plant species, sequences can be modified to account for the specific codon preferences and GC content preferences of monocotyledonous plants or dicotyledonous plants as these preferences have been shown to differ (Murray, et al., (1989) *Nucleic Acids Res.* 17:477-98 and herein incorporated by reference). Thus, the maize preferred codon for a particular amino acid might be derived from known gene sequences from maize. Maize codon usage for 28 genes from maize plants is listed in Table 4 of Murray, et al., supra.

As used herein, "heterologous" in reference to a nucleic acid is a nucleic acid that originates from a foreign species, or, if from the same species, is substantially modified from its native form in composition and/or genomic locus by deliberate human intervention. For example, a promoter operably linked to a heterologous structural gene is from a species different from that from which the structural gene was derived or, if from the same species, one or both are substantially modified from their original form. A heterologous protein may originate from a foreign species or, if from the same species, is substantially modified from its original form by deliberate human intervention.

By "host cell" is meant a cell, which comprises a heterologous nucleic acid sequence of the invention, which contains a vector and supports the replication and/or expression of the expression vector. Host cells may be prokaryotic cells such as *E. coli*, or eukaryotic cells such as yeast, insect, plant, amphibian, or mammalian cells. Preferably, host cells are monocotyledonous or dicotyledonous plant cells, including but not limited to maize, sorghum, sunflower, soybean, wheat, alfalfa, rice, cotton, canola, barley, millet, and tomato. A particularly preferred lo monocotyledonous host cell is a maize host cell.

The term "hybridization complex" includes reference to a duplex nucleic acid structure formed by two single-stranded nucleic acid sequences selectively hybridized with each other.

The term "introduced" in the context of inserting a nucleic acid into a cell, means "transfection" or "transformation" or "transduction" and includes reference to the incorporation of a nucleic acid into a eukaryotic or prokaryotic cell where the nucleic acid may be incorporated into the genome of the cell (e.g., chromosome, plasmid, plastid or mitochondrial DNA), converted into an autonomous replicon, or transiently expressed (e.g., transfected mRNA).

The terms "isolated" refers to material, such as a nucleic acid or a protein, which is substantially or essentially free from components which normally accompany or interact with it as found in its naturally occurring environment. The isolated material optionally comprises material not found with the material in its natural environment. Nucleic acids, which are "isolated", as defined herein, are also referred to as "heterologous" nucleic acids. Unless otherwise stated, the term "NUE nucleic acid" means a nucleic acid comprising a polynucleotide ("NUE polynucleotide") encoding a full length or partial length NUE polypeptide.

As used herein, "nucleic acid" includes reference to a deoxyribonucleotide or ribonucleotide polymer in either single- or double-stranded form, and unless otherwise limited, encompasses known analogues having the essential nature of natural nucleotides in that they hybridize to single-stranded nucleic acids in a manner similar to naturally occurring nucleotides (e.g., peptide nucleic acids).

By "nucleic acid library" is meant a collection of isolated DNA or RNA molecules, which comprise and substantially represent the entire transcribed fraction of a genome of a specified organism. Construction of exemplary nucleic acid libraries, such as genomic and cDNA libraries, is taught in standard molecular biology references such as Berger and Kimmel, (1987) *Guide To Molecular Cloning Techniques*, from the series *Methods in Enzymology*, vol. 152, Academic Press, Inc., San Diego, Calif.; Sambrook, et al., (1989) *Molecular Cloning: A Laboratory Manual, $2^{nd}$ ed.*, vols. 1-3; and *Current Protocols in Molecular Biology*, Ausubel, et al., eds, Current Protocols, a joint venture between Greene Publishing Associates, Inc. and John Wiley & Sons, Inc. (1994 Supplement).

As used herein "operably linked" includes reference to a functional linkage between a first sequence, such as a promoter, and a second sequence, wherein the promoter sequence initiates and mediates transcription of the DNA corresponding to the second sequence. Generally, operably linked means that the nucleic acid sequences being linked are contiguous and, where necessary to join two protein coding regions, contiguous and in the same reading frame.

As used herein, the term "plant" includes reference to whole plants, plant organs (e.g., leaves, stems, roots, etc.), seeds and plant cells and progeny of same. Plant cell, as used herein includes, without limitation, seeds, suspension cultures, embryos, meristematic regions, callus tissue, leaves, roots, shoots, gametophytes, sporophytes, pollen, and microspores. The class of plants, which can be used in the methods of the invention, is generally as broad as the class of higher plants amenable to transformation techniques, including both monocotyledonous and dicotyledonous plants including species from the genera: *Cucurbita, Rosa, Vitis, Juglans, Fragaria, Lotus, Medicago, Onobrychis, Trifolium, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersicon, Nicotiana, Solanum, Petunia, Digitalis, Majorana, Ciahorium, Helianthus, Lactuca, Bromus, Asparagus, Antirrhinum, Heterocallis, Nemesis, Pelargonium, Panieum, Pennisetum, Ranunculus, Senecio, Salpiglossis, Cucumis, Browaalia, Glycine, Pisum, Phaseolus, Lolium, Oryza, Avena, Hordeum, Secale, Allium,* and *Triticum*. A particularly preferred plant is *Zea mays*.

As used herein, "yield" may include reference to bushels per acre of a grain crop at harvest, as adjusted for grain moisture (15% typically for maize, for example), and the volume of biomass generated (for forage crops such as alfalfa, and plant root size for multiple crops). Grain moisture is measured in the grain at harvest. The adjusted test weight of grain is determined to be the weight in pounds per bushel, adjusted for grain moisture level at harvest. Biomass is measured as the weight of harvestable plant material generated.

As used herein, "polynucleotide" includes reference to a deoxyribopolynucleotide, ribopolynucleotide, or analogs thereof that have the essential nature of a natural ribonucleotide in that they hybridize, under stringent hybridization conditions, to substantially the same nucleotide sequence as naturally occurring nucleotides and/or allow translation into the same amino acid(s) as the naturally occurring nucleotide(s). A polynucleotide can be full-length or a subsequence of a native or heterologous structural or regulatory gene. Unless otherwise indicated, the term includes reference to the specified sequence as well as the complementary sequence thereof. Thus, DNAs or RNAs with backbones modified for stability or for other reasons are "polynucleotides" as that term is intended herein. Moreover, DNAs or RNAs comprising unusual bases, such as inosine, or modified bases, such as tritylated bases, to name just two examples, are polynucleotides as the term is used herein. It will be appreciated that a great variety of modifications have been made to DNA and RNA that serve many useful purposes known to those of skill in the art. The term polynucleotide as it is employed herein embraces such chemically, enzymatically or metabolically modified forms of polynucleotides, as well as the chemical forms of DNA and RNA characteristic of viruses and cells, including inter alia, simple and complex cells.

The terms "polypeptide," "peptide," and "protein" are used interchangeably herein to refer to a polymer of amino acid residues. The terms apply to amino acid polymers in which one or more amino acid residue is an artificial chemical analogue of a corresponding naturally occurring amino acid, as well as to naturally occurring amino acid polymers.

As used herein "promoter" includes reference to a region of DNA upstream from the start of transcription and involved in recognition and binding of RNA polymerase and other proteins to initiate transcription. A "plant promoter" is a promoter capable of initiating transcription in plant cells. Exemplary plant promoters include, but are not limited to, those that are obtained from plants, plant viruses, and bacteria which comprise genes expressed in plant cells such *Agrobacterium* or *Rhizobium*. Examples are promoters that preferentially initiate transcription in certain tissues, such as leaves, roots, seeds, fibres, xylem vessels, tracheids, or sclerenchyma. Such promoters are referred to as "tissue preferred." A "cell type" specific promoter primarily drives expression in certain cell types in one or more organs, for example, vascular cells in roots or leaves. An "inducible" or "regulatable" promoter is a promoter, which is under environmental control. Examples of environmental conditions that may effect transcription by inducible promoters include anaerobic conditions or the presence of light. Another type of promoter is a developmentally regulated promoter, for example, a promoter that drives expression during pollen development. Tissue preferred, cell type specific, developmentally regulated, and inducible promoters constitute the class of "non-constitutive" promoters. A "constitutive" promoter is a promoter, which is active under most environmental conditions.

The term "NUE polypeptide" refers to one or more amino acid sequences. The term is also inclusive of fragments, variants, homologs, alleles or precursors (e.g., preproproteins or proproteins) thereof. A "NUE protein" comprises a NUE polypeptide. Unless otherwise stated, the term "NUE nucleic acid" means a nucleic acid comprising a polynucleotide ("NUE polynucleotide") encoding a NUE polypeptide.

As used herein "recombinant" includes reference to a cell or vector, that has been modified by the introduction of a heterologous nucleic acid or that the cell is derived from a cell so modified. Thus, for example, recombinant cells express genes that are not found in identical form within the native (non-recombinant) form of the cell or express native genes that are otherwise abnormally expressed, under expressed or not expressed at all as a result of deliberate human intervention; or may have reduced or eliminated expression of a native gene. The term "recombinant" as used herein does not encompass the alteration of the cell or vector by naturally occurring events (e.g., spontaneous mutation, natural transformation/transduction/transposition) such as those occurring without deliberate human intervention.

As used herein, a "recombinant expression cassette" is a nucleic acid construct, generated recombinantly or synthetically, with a series of specified nucleic acid elements, which permit transcription of a particular nucleic acid in a target cell. The recombinant expression cassette can be incorporated into a plasmid, chromosome, mitochondrial DNA, plastid DNA, virus, or nucleic acid fragment. Typically, the recombinant expression cassette portion of an expression vector includes, among other sequences, a nucleic acid to be transcribed, and a promoter.

The terms "residue" or "amino acid residue" or "amino acid" are used interchangeably herein to refer to an amino acid that is incorporated into a protein, polypeptide, or peptide (collectively "protein"). The amino acid may be a naturally occurring amino acid and, unless otherwise limited, may encompass known analogs of natural amino acids that can function in a similar manner as naturally occurring amino acids.

The term "selectively hybridizes" includes reference to hybridization, under stringent hybridization conditions, of a nucleic acid sequence to a specified nucleic acid target sequence to a detectably greater degree (e.g., at least 2-fold over background) than its hybridization to non-target nucleic acid sequences and to the substantial exclusion of non-target nucleic acids. Selectively hybridizing sequences typically have about at least 40% sequence identity, preferably 60-90% sequence identity, and most preferably 100% sequence identity (i.e., complementary) with each other.

The terms "stringent conditions" or "stringent hybridization conditions" include reference to conditions under which a probe will hybridize to its target sequence, to a detectably greater degree than other sequences (e.g., at least 2-fold over background). Stringent conditions are sequence-dependent and will be different in different circumstances. By controlling the stringency of the hybridization and/or washing conditions, target sequences can be identified which can be up to 100% complementary to the probe (homologous probing). Alternatively, stringency conditions can be adjusted to allow some mismatching in sequences so that lower degrees of similarity are detected (heterologous probing). Optimally, the probe is approximately 500 nucleotides in length, but can vary greatly in length from less than 500 nucleotides to equal to the entire length of the target sequence.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide or Denhardt's. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Specificity is typically the function of post-hybridization washes, the critical factors being the ionic strength and temperature of the final wash solution. For DNA-DNA hybrids, the $T_m$ can be approximated from the equation of Meinkoth and Wahl, (1984) *Anal. Biochem.*, 138:267-84: $T_m$=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe. $T_m$ is reduced by about 1° C. for each 1% of mismatching; thus, $T_m$, hybridization and/or wash conditions can be adjusted to hybridize to sequences of the desired identity. For example, if sequences with ≧90% identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/or wash at 1, 2, 3 or 4° C. lower than the thermal melting point ($T_m$); moderately stringent conditions can utilize a hybridization and/or wash at 6, 7, 8, 9 or 10° C. lower than the thermal melting point ($T_m$); low stringency conditions can utilize a hybridization and/or wash at 11, 12, 13, 14, 15 or 20° C. lower than the thermal melting point ($T_m$). Using the equation, hybridization and wash compositions, and desired $T_m$, those of ordinary skill will understand that variations in the stringency of hybridization and/or wash solutions are inherently described. If the desired degree of mismatching results in a $T_m$ of less than 45° C. (aqueous solution) or 32° C. (formamide solution) it is preferred to increase the SSC concentration so that a higher temperature can be used. An extensive guide to the hybridization of nucleic acids is found in Tijssen, *Laboratory Techniques in Biochemistry and Molecular Biology-Hybridization with Nucleic Acid Probes*, part I, chapter 2, "Overview of principles of hybridization and the strategy of nucleic acid probe assays," Elsevier, New York (1993); and *Current Protocols in Molecular Biology*, chapter 2, Ausubel, et al., eds, Greene Publishing and Wiley-Interscience, New York (1995). Unless otherwise stated, in the present application high stringency is defined as hybridization in 4× SSC, 5× Denhardt's (5 g Ficoll, 5 g polyvinylpyrrolidone, 5 g bovine serum albumin in 500 ml of water), 0.1 mg/ml boiled salmon sperm DNA, and 25 mM Na phosphate at 65° C., and a wash in 0.1×SSC, 0.1% SDS at 65° C.

As used herein, "transgenic plant" includes reference to a plant, which comprises within its genome a heterologous polynucleotide. Generally, the heterologous polynucleotide is stably integrated within the genome such that the polynucleotide is passed on to successive generations. The heterologous polynucleotide may be integrated into the genome alone or as part of a recombinant expression cassette. "Transgenic" is used herein to include any cell, cell line, callus, tissue, plant part or plant, the genotype of which has been altered by the presence of heterologous nucleic acid including those transgenics initially so altered as well as those created by sexual crosses or asexual propagation from the initial transgenic. The term "transgenic" as used herein does not encompass the alteration of the genome (chromosomal or extra-chromosomal) by conventional plant breeding methods or by naturally occurring events such as random cross-fertilization, non-recombinant viral infection, non-recombinant bacterial transformation, non-recombinant transposition, or spontaneous mutation.

As used herein, "vector" includes reference to a nucleic acid used in transfection of a host cell and into which can be inserted a polynucleotide. Vectors are often replicons. Expression vectors permit transcription of a nucleic acid inserted therein.

The following terms are used to describe the sequence relationships between two or more nucleic acids or polynucleotides or polypeptides: (a) "reference sequence," (b) "comparison window," (c) "sequence identity," (d) "percentage of sequence identity," and (e) "substantial identity."

As used herein, "reference sequence" is a defined sequence used as a basis for sequence comparison. A reference sequence may be a subset or the entirety of a specified sequence; for example, as a segment of a full-length cDNA or gene sequence, or the complete cDNA or gene sequence.

As used herein, "comparison window" means includes reference to a contiguous and specified segment of a polynucleotide sequence, wherein the polynucleotide sequence may be compared to a reference sequence and wherein the portion of the polynucleotide sequence in the comparison window may comprise additions or deletions (i.e., gaps) compared to the reference sequence (which does not comprise additions or deletions) for optimal alignment of the two sequences. Generally, the comparison window is at least 20 contiguous nucleotides in length, and optionally can be 30, 40, 50, 100 or longer. Those of skill in the art understand that to avoid a high similarity to a reference sequence due to inclusion of gaps in the polynucleotide sequence a gap penalty is typically introduced and is subtracted from the number of matches.

Methods of alignment of nucleotide and amino acid sequences for comparison are well known in the art. The local homology algorithm (BESTFIT) of Smith and Waterman, (1981) *Adv. Appl. Math* 2:482, may conduct optimal alignment of sequences for comparison; by the homology alignment algorithm (GAP) of Needleman and Wunsch, (1970) *J. Mol. Biol.* 48:443-53; by the search for similarity method (Tfasta and Fasta) of Pearson and Lipman, (1988) *Proc. Natl. Acad. Sci. USA* 85:2444; by computerized implementations of these algorithms, including, but not limited to: CLUSTAL in the PC/Gene program by Intelligenetics, Mountain View, Calif., GAP, BESTFIT, BLAST, FASTA, and TFASTA in the Wisconsin Genetics Software Package, Version 8 (available from Genetics Computer Group (GCG® programs (Accelrys, Inc., San Diego, Calif.).). The CLUSTAL program is well described by Higgins and Sharp, (1988) *Gene* 73:237-44; Higgins and Sharp, (1989) *CABIOS* 5:151-3; Corpet, et al., (1988) *Nucleic Acids Res.* 16:10881-90; Huang, et al., (1992) *Computer Applications in the Biosciences* 8:155-65, and Pearson, et al., (1994) *Meth. Mol. Biol.* 24:307-31. The preferred program to use for optimal global alignment of multiple sequences is PileUp (Feng and Doolittle, (1987) *J. Mol. Evol.*, 25:351-60 which is similar to the method described by Higgins and Sharp, (1989) *CABIOS* 5:151-53 and hereby incorporated by reference). The BLAST family of programs which can be used for database similarity searches includes: BLASTN for nucleotide query sequences against nucleotide database sequences; BLASTX for nucleotide query sequences against protein database sequences; BLASTP for protein query sequences against protein database sequences; TBLASTN for protein query sequences against nucleotide database sequences; and TBLASTX for nucleotide query sequences against nucleotide database sequences. See, *Current Protocols in Molecular Biology*, Chapter 19, Ausubel et al., eds., Greene Publishing and Wiley-Interscience, New York (1995).

GAP uses the algorithm of Needleman and Wunsch, supra, to find the alignment of two complete sequences that maximizes the number of matches and minimizes the number of gaps. GAP considers all possible alignments and gap positions and creates the alignment with the largest number of matched bases and the fewest gaps. It allows for the provision of a gap creation penalty and a gap extension penalty in units of matched bases. GAP must make a profit of gap creation penalty number of matches for each gap it inserts. If a gap extension penalty greater than zero is chosen, GAP must, in addition, make a profit for each gap inserted of the length of the gap times the gap extension penalty. Default gap creation penalty values and gap extension penalty values in Version 10 of the Wisconsin Genetics Software Package are 8 and 2, respectively. The gap creation and gap extension penalties can be expressed as an integer selected from the group of integers consisting of from 0 to 100. Thus, for example, the gap creation and gap extension penalties can be 0, 1, 2, 3, 4, 5, 6, 7, 8, 9, 10, 15, 20, 30, 40, 50 or greater.

GAP presents one member of the family of best alignments. There may be many members of this family, but no other member has a better quality. GAP displays four figures of merit for alignments: Quality, Ratio, Identity, and Similarity. The Quality is the metric maximized in order to align the sequences. Ratio is the quality divided by the number of bases in the shorter segment. Percent Identity is the percent of the symbols that actually match. Percent Similarity is the percent of the symbols that are similar. Symbols that are across from gaps are ignored. A similarity is scored when the scoring matrix value for a pair of symbols is greater than or equal to 0.50, the similarity threshold. The scoring matrix used in Version 10 of the Wisconsin Genetics Software Package is BLOSUM62 (see, Henikoff and Henikoff, (1989) *Proc. Natl. Acad. Sci. USA* 89:10915).

Unless otherwise stated, sequence identity/similarity values provided herein refer to the value obtained using the BLAST 2.0 suite of programs using default parameters (Altschul, et al., (1997) *Nucleic Acids Res.* 25:3389-402).

As those of ordinary skill in the art will understand, BLAST searches assume that proteins can be modeled as random sequences. However, many real proteins comprise regions of nonrandom sequences, which may be homopolymeric tracts, short-period repeats, or regions enriched in one or more amino acids. Such low-complexity regions may be aligned between unrelated proteins even though other regions of the protein are entirely dissimilar. A number of low-complexity filter programs can be employed to reduce such low-complexity alignments. For example, the SEG (Wooten and Federhen, (1993) *Comput. Chem.* 17:149-63) and XNU (Claverie and States, (1993) *Comput. Chem.* 17:191-201) low-complexity filters can be employed alone or in combination.

As used herein, "sequence identity" or "identity" in the context of two nucleic acid or polypeptide sequences includes reference to the residues in the two sequences, which are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. Where sequences differ in conservative substitutions, the percent sequence identity may be adjusted upwards to correct for the conservative nature of the substitution. Sequences, which differ by such conservative substitutions, are said to have "sequence similarity" or "similarity." Means for making this adjustment are well known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Meyers and Miller, (1988) *Computer Applic. Biol. Sci.* 4:11-17, e.g., as implemented in the program PC/GENE (Intelligenetics, Mountain View, Calif., USA).

As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity.

The term "substantial identity" of polynucleotide sequences means that a polynucleotide comprises a sequence that has between 50-100% sequence identity, preferably at least 50% sequence identity, preferably at least 60% sequence identity, preferably at least 70%, more preferably at least 80%, more preferably at least 90%, and most preferably at least 95%, compared to a reference sequence using one of the alignment programs described using standard parameters. One of skill will recognize that these values can be appropriately adjusted to determine corresponding identity of proteins encoded by two nucleotide sequences by taking into account codon degeneracy, amino acid similarity, reading frame positioning and the like. Substantial identity of amino acid sequences for these purposes normally means sequence identity of between 55-100%, preferably at least 55%, preferably at least 60%, more preferably at least 70%, 80%, 90%, and most preferably at least 95%.

Another indication that nucleotide sequences are substantially identical is if two molecules hybridize to each other under stringent conditions. The degeneracy of the genetic code allows for many amino acids substitutions that lead to variety in the nucleotide sequence that code for the same amino acid, hence it is possible that the DNA sequence could code for the same polypeptide but not hybridize to each other under stringent conditions. This may occur, e.g., when a copy of a nucleic acid is created using the maximum codon degeneracy permitted by the genetic code. One indication that two nucleic acid sequences are substantially identical is that the polypeptide, which the first nucleic acid encodes, is immunologically cross reactive with the polypeptide encoded by the second nucleic acid.

The terms "substantial identity" in the context of a peptide indicates that a peptide comprises a sequence with between 55-100% sequence identity to a reference sequence preferably at least 55% sequence identity, preferably 60% preferably 70%, more preferably 80%, most preferably at least 90% or 95% sequence identity to the reference sequence over a specified comparison window. Preferably, optimal alignment is conducted using the homology alignment algorithm of Needleman and Wunsch, supra. An indication that two peptide sequences are substantially identical is that one peptide is immunologically reactive with antibodies raised against the second peptide. Thus, a peptide is substantially identical to a second peptide, for example, where the two peptides differ only by a conservative substitution. In addition, a peptide can be substantially identical to a second peptide when they differ by a non-conservative change if the epitope that the antibody recognizes is substantially identical. Peptides, which are "substantially similar" share sequences as, noted above except that residue positions, which are not identical, may differ by conservative amino acid changes.

The invention discloses NUE polynucleotides and polypeptides. The novel nucleotides and proteins of the invention have an expression pattern which indicates that they enhance nitrogen utilization and thus play an important role in plant development. The polynucleotides are expressed in various plant tissues. The polynucleotides and polypeptides thus provide an opportunity to manipulate plant development to alter tissue development, timing or composition. This may be used to create a plant with enhanced yield under limited nitrogen supply.

Nucleic Acids

The present invention provides, inter alia, isolated nucleic acids of RNA, DNA, and analogs and/or chimeras thereof, comprising a NUE polynucleotide.

The present invention also includes polynucleotides optimized for expression in different organisms. For example, for expression of the polynucleotide in a maize plant, the sequence can be altered to account for specific codon preferences and to alter GC content as according to Murray, et al, supra. Maize codon usage for 28 genes from maize plants is listed in Table 4 of Murray, et al., supra.

The NUE nucleic acids of the present invention comprise isolated NUE polynucleotides which are inclusive of:
(a) a polynucleotide encoding a NUE polypeptide and conservatively modified and polymorphic variants thereof;
(b) a polynucleotide having at least 70% sequence identity with polynucleotides of (a) or (b);
(c) complementary sequences of polynucleotides of (a) or (b).

Construction of Nucleic Acids

The isolated nucleic acids of the present invention can be made using (a) standard recombinant methods, (b) synthetic techniques, or combinations thereof. In some embodiments, the polynucleotides of the present invention will be cloned, amplified, or otherwise constructed from a fungus or bacteria.

The nucleic acids may conveniently comprise sequences in addition to a polynucleotide of the present invention. For example, a multi-cloning site comprising one or more endonuclease restriction sites may be inserted into the nucleic acid to aid in isolation of the polynucleotide. Also, translatable sequences may be inserted to aid in the isolation of the translated polynucleotide of the present invention. For example, a hexa-histidine marker sequence provides a convenient means to purify the proteins of the present invention. The nucleic acid of the present invention—excluding the polynucleotide sequence—is optionally a vector, adapter, or linker for cloning and/or expression of a polynucleotide of the present invention. Additional sequences may be added to such cloning and/or expression sequences to optimize their function in cloning and/or expression, to aid in isolation of the polynucleotide, or to improve the introduction of the polynucleotide into a cell. Typically, the length of a nucleic acid of the present invention less the length of its polynucleotide of the present invention is less than 20 kilobase pairs, often less than 15 kb, and frequently less than 10 kb. Use of cloning vectors, expression vectors, adapters, and linkers is well known in the art.

Exemplary nucleic acids include such vectors as: M13, lambda ZAP Express, lambda ZAP II, lambda gt10, lambda gt11, pBK-CMV, pBK-RSV, pBluescript II, lambda DASH II, lambda EMBL 3, lambda EMBL 4, pWE15, SuperCos 1, SurfZap, Uni-ZAP, pBC, pBS+/−, pSG5, pBK, pCR-Script, pET, pSPUTK, p3'SS, pGEM, pSK+/−, pGEX, pSPORTI and II, pOPRSVI CAT, pOPI3 CAT, pXT1, pSG5, pPbac, pMbac, pMC1neo, pOG44, pOG45, pFRTβGAL, pNEOβGAL, pRS403, pRS404, pRS405, pRS406, pRS413, pRS414, pRS415, pRS416, lambda MOSSIox, and lambda MOSEIox. Optional vectors for the present invention, include but are not limited to, lambda ZAP II, and pGEX. For a description of various nucleic acids see, e.g., Stratagene Cloning Systems, Catalogs 1995, 1996, 1997 (La Jolla, Calif.); and, Amersham Life Sciences, Inc, Catalog '97 (Arlington Heights, Ill.).

Synthetic Methods for Constructing Nucleic Acids

The isolated nucleic acids of the present invention can also be prepared by direct chemical synthesis by methods such as the phosphotriester method of Narang, et al., (1979) *Meth. Enzymol.* 68:90-9; the phosphodiester method of Brown, et al., (1979) *Meth. Enzymol.* 68:109-51; the diethylphosphoramidite method of Beaucage, et al., (1981) *Tetra. Letts.* 22(20): 1859-62; the solid phase phosphoramidite triester method described by Beaucage, et al., supra, e.g., using an automated synthesizer, e.g., as described in Needham-VanDevanter, et al., (1984) *Nucleic Acids Res.* 12:6159-68; and, the solid support method of U.S. Pat. No. 4,458,066. Chemical synthesis generally produces a single stranded oligonucleotide. This may be converted into double stranded DNA by hybridization with a complementary sequence or by polymerization with a DNA polymerase using the single strand as a template. One of skill will recognize that while chemical synthesis of DNA is limited to sequences of about 100 bases, longer sequences may be obtained by the ligation of shorter sequences.

UTRs and Codon Preference

In general, translational efficiency has been found to be regulated by specific sequence elements in the 5' non-coding or untranslated region (5' UTR) of the RNA. Positive sequence motifs include translational initiation consensus sequences (Kozak, (1987) *Nucleic Acids Res.*15:8125) and the 5<G>7 methyl GppppG RNA cap structure (Drummond, et al., (1985) *Nucleic Acids Res.* 13:7375). Negative elements include stable intramolecular 5' UTR stem-loop structures (Muesing, et al., (1987) *Cell* 48:691) and AUG sequences or short open reading frames preceded by an appropriate AUG in the 5' UTR (Kozak, supra, Rao, et al., (1988) *Mol. and Cell. Biol.* 8:284). Accordingly, the present invention provides 5' and/or 3' UTR regions for modulation of translation of heterologous coding sequences.

Further, the polypeptide-encoding segments of the polynucleotides of the present invention can be modified to alter codon usage. Altered codon usage can be employed to alter translational efficiency and/or to optimize the coding sequence for expression in a desired host or to optimize the codon usage in a heterologous sequence for expression in maize. Codon usage in the coding regions of the polynucleotides of the present invention can be analyzed statistically using commercially available software packages such as "Codon Preference" available from the University of Wisconsin Genetics Computer Group. See, Devereaux, et al., (1984) *Nucleic Acids Res.* 12:387-395); or MacVector 4.1 (Eastman Kodak Co., New Haven, Conn.). Thus, the present invention provides a codon usage frequency characteristic of the coding region of at least one of the polynucleotides of the present invention. The number of polynucleotides (3 nucleotides per amino acid) that can be used to determine a codon usage frequency can be any integer from 3 to the number of polynucleotides of the present invention as provided herein. Optionally, the polynucleotides will be full-length sequences. An exemplary number of sequences for statistical analysis can be at least 1, 5, 10, 20, 50 or 100.

Sequence Shuffling

The present invention provides methods for sequence shuffling using polynucleotides of the present invention, and compositions resulting therefrom. Sequence shuffling is described in PCT publication No. 96/19256. See also, Zhang, et al., (1997) *Proc. Natl. Acad. Sci. USA* 94:4504-9; and Zhao, et al., (1998) *Nature Biotech* 16:258-61. Generally, sequence shuffling provides a means for generating libraries of polynucleotides having a desired characteristic, which can be selected or screened for. Libraries of recombinant polynucleotides are generated from a population of related sequence polynucleotides, which comprise sequence regions, which have substantial sequence identity and can be homologously recombined in vitro or in vivo. The population of sequence-recombined polynucleotides comprises a subpopulation of polynucleotides which possess desired or advantageous characteristics and which can be selected by a suitable selection or screening method. The characteristics can be any property or attribute capable of being selected for or detected in a screening system, and may include properties of: an encoded protein, a transcriptional element, a sequence controlling transcription, RNA processing, RNA stability, chromatin conformation, translation, or other expression property of a gene or transgene, a replicative element, a protein-binding element, or the like, such as any feature which confers a selectable or detectable property. In some embodiments, the selected characteristic will be an altered $K_m$ and/or $K_{cat}$ over the wild-type protein as provided herein. In other embodiments, a protein or polynucleotide generated from sequence shuffling will have a ligand binding affinity greater than the non-shuffled wild-type polynucleotide. In yet other embodiments, a protein or polynucleotide generated from sequence shuffling will have an altered pH optimum as compared to the non-shuffled wild-type polynucleotide. The increase in such properties can be at least 110%, 120%, 130%, 140% or greater than 150% of the wild-type value.

Recombinant Expression Cassettes

The present invention further provides recombinant expression cassettes comprising a nucleic acid of the present invention. A nucleic acid sequence coding for the desired polynucleotide of the present invention, for example a cDNA or a genomic sequence encoding a polypeptide long enough to code for an active protein of the present invention, can be used to construct a recombinant expression cassette which can be introduced into the desired host cell. A recombinant expression cassette will typically comprise a polynucleotide of the present invention operably linked to transcriptional initiation regulatory sequences which will direct the transcription of the polynucleotide in the intended host cell, such as tissues of a transformed plant.

For example, plant expression vectors may include (1) a cloned plant gene under the transcriptional control of 5' and 3' regulatory sequences and (2) a dominant selectable marker. Such plant expression vectors may also contain, if desired, a promoter regulatory region (e.g., one conferring inducible or constitutive, environmentally- or developmentally-regulated, or cell- or tissue-specific/selective expression), a transcription initiation start site, a ribosome binding site, an RNA processing signal, a transcription termination site, and/or a polyadenylation signal.

A plant promoter fragment can be employed which will direct expression of a polynucleotide of the present invention in all tissues of a regenerated plant. Such promoters are referred to herein as "constitutive" promoters and are active under most environmental conditions and states of development or cell differentiation. Examples of constitutive promoters include the 1'- or 2'- promoter derived from T-DNA of *Agrobacterium tumefaciens*, the Smas promoter, the cinnamyl alcohol dehydrogenase promoter (U.S. Pat. No. 5,683,439), the Nos promoter, the rubisco promoter, the GRP1-8 promoter, the 35S promoter from cauliflower mosaic virus (CaMV), as described in Odell, et al., (1985) *Nature* 313:810-2; rice actin (McElroy, et al., (1990) *Plant Cell* 163-171); ubiquitin (Christensen, et al., (1992) *Plant Mol. Biol.* 12:619-632 and Christensen, et al., (1992) *Plant Mol. Biol.* 18:675-89); pEMU (Last, et al., (1991) *Theor. Appl. Genet.* 81:581-8); MAS (Velten, et al., (1984) *EMBO J.* 3:2723-30); and maize H3 histone (Lepetit, et al., (1992) *Mol. Gen. Genet.* 231:276-85; and Atanassvoa, et al., (1992) *Plant Journal* 2(3):291-300); ALS promoter, as described in PCT Application No. WO 96/30530; and other transcription initiation regions from various plant genes known to those of skill. For the present invention ubiquitin is the preferred promoter for expression in monocot plants.

Alternatively, the plant promoter can direct expression of a polynucleotide of the present invention in a specific tissue or may be otherwise under more precise environmental or developmental control. Such promoters are referred to here as "inducible" promoters. Environmental conditions that may effect transcription by inducible promoters include pathogen attack, anaerobic conditions, or the presence of light. Examples of inducible promoters are the Adh1 promoter, which is inducible by hypoxia or cold stress, the Hsp70 promoter, which is inducible by heat stress, and the PPDK promoter, which is inducible by light.

Examples of promoters under developmental control include promoters that initiate transcription only, or preferentially, in certain tissues, such as leaves, roots, fruit, seeds, or flowers. The operation of a promoter may also vary depending on its location in the genome. Thus, an inducible promoter may become fully or partially constitutive in certain locations.

If polypeptide expression is desired, it is generally desirable to include a polyadenylation region at the 3'-end of a polynucleotide coding region. The polyadenylation region can be derived from a variety of plant genes, or from T-DNA. The 3' end sequence to be added can be derived from, for example, the nopaline synthase or octopine synthase genes, or alternatively from another plant gene, or less preferably from any other eukaryotic gene. Examples of such regulatory elements include, but are not limited to, 3' termination and/or polyadenylation regions such as those of the *Agrobacterium tumefaciens* nopaline synthase (nos) gene (Bevan, et al., (1983) *Nucleic Acids Res.* 12:369-85); the potato proteinase inhibitor II (PINII) gene (Keil, et al., (1986) *Nucleic Acids Res.* 14:5641-50; and An, et al., (1989) *Plant Cell* 1:115-22); and the CaMV 19S gene (Mogen, et al., (1990) *Plant Cell* 2:1261-72).

An intron sequence can be added to the 5' untranslated region or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg, (1988) *Mol. Cell Biol.* 8:4395-4405; Callis, et al., (1987) *Genes Dev.* 1:1183-200). Such intron enhancement of gene expression is typically greatest when placed near the 5' end of the transcription unit. Use of maize introns Adh1-S intron 1, 2 and 6, the Bronze-1 intron are known in the art. See generally, *The Maize Handbook*, Chapter 116, Freeling and Walbot, eds., Springer, New York (1994).

Plant signal sequences, including, but not limited to, signal-peptide encoding DNA/RNA sequences which target proteins to the extracellular matrix of the plant cell (Dratewka-Kos, et al., (1989) *J. Biol. Chem.* 264:4896-900), such as the *Nicotiana plumbaginifolia* extension gene (DeLoose, et al., (1991) *Gene* 99:95-100); signal peptides which target proteins to the vacuole, such as the sweet potato sporamin gene (Matsuka, et al., (1991) *Proc. Natl. Acad. Sci. USA* 88:834) and the barley lectin gene (Wilkins, et al., (1990) *Plant Cell*, 2:301-13); signal peptides which cause proteins to be secreted, such as that of PRIb (Lind, et al., (1992) *Plant Mol. Biol.* 18:47-53) or the barley alpha amylase (BAA) (Rahmatullah, et al., (1989) *Plant Mol. Biol.* 12:119, and hereby incorporated by reference), or signal peptides which target proteins to the plastids such as that of rapeseed enoyl-Acp reductase (Verwaert, et al., (1994) *Plant Mol. Biol.* 26:189-202) are useful in the invention.

The vector comprising the sequences from a polynucleotide of the present invention will typically comprise a marker gene, which confers a selectable phenotype on plant cells. Usually, the selectable marker gene will encode antibiotic resistance, with suitable genes including genes coding for resistance to the antibiotic spectinomycin (e.g., the aada gene), the streptomycin phosphotransferase (SPT) gene coding for streptomycin resistance, the neomycin phosphotransferase (NPTII) gene encoding kanamycin or geneticin resistance, the hygromycin phosphotransferase (HPT) gene coding for hygromycin resistance, genes coding for resistance to herbicides which act to inhibit the action of acetolactate synthase (ALS), in particular the sulfonylurea-type herbicides (e.g., the acetolactate synthase (ALS) gene containing mutations leading to such resistance in particular the S4 and/or Hra mutations), genes coding for resistance to herbicides which act to inhibit action of glutamine synthase, such as phosphinothricin or basta (e.g., the bar gene), or other such genes known in the art. The bar gene encodes resistance to the herbicide basta, and the ALS gene encodes resistance to the herbicide chlorsulfuron.

Typical vectors useful for expression of genes in higher plants are well known in the art and include vectors derived from the tumor-inducing (Ti) plasmid of *Agrobacterium tumefaciens* described by Rogers, et al. (1987), *Meth. Enzymol.* 153:253-77. These vectors are plant integrating vectors in that on transformation, the vectors integrate a portion of vector DNA into the genome of the host plant. Exemplary *A. tumefaciens* vectors useful herein are plasmids pKYLX6 and pKYLX7 of Schardl, et al., (1987) *Gene* 61:1-11, and Berger, et al., (1989) *Proc. Natl. Acad. Sci. USA*, 86:8402-6. Another useful vector herein is plasmid pBI101.2 that is available from CLONTECH Laboratories, Inc. (Palo Alto, Calif.).

Expression of Proteins in Host Cells

Using the nucleic acids of the present invention, one may express a protein of the present invention in a recombinantly engineered cell such as bacteria, yeast, insect, mammalian, or preferably plant cells. The cells produce the protein in a non-natural condition (e.g., in quantity, composition, location, and/or time), because they have been genetically altered through human intervention to do so.

It is expected that those of skill in the art are knowledgeable in the numerous expression systems available for expression of a nucleic acid encoding a protein of the present invention.

No attempt to describe in detail the various methods known for the expression of proteins in prokaryotes or eukaryotes will be made.

In brief summary, the expression of isolated nucleic acids encoding a protein of the present invention will typically be achieved by operably linking, for example, the DNA or cDNA to a promoter (which is either constitutive or inducible), followed by incorporation into an expression vector. The vectors can be suitable for replication and integration in either prokaryotes or eukaryotes. Typical expression vectors contain transcription and translation terminators, initiation sequences, and promoters useful for regulation of the expression of the DNA encoding a protein of the present invention. To obtain high level expression of a cloned gene, it is desirable to construct expression vectors which contain, at the minimum, a strong promoter, such as ubiquitin, to direct transcription, a ribosome binding site for translational initiation, and a transcription/translation terminator. Constitutive promoters are classified as providing for a range of constitutive expression. Thus, some are weak constitutive promoters, and others are strong constitutive promoters. Generally, by "weak promoter" is intended a promoter that drives expression of a coding sequence at a low level. By "low level" is intended at levels of about 1/10,000 transcripts to about 1/100,000 transcripts to about 1/500,000 transcripts. Conversely, a "strong promoter" drives expression of a coding sequence at a "high level," or about 1/10 transcripts to about 1/100 transcripts to about 1/1,000 transcripts.

One of skill would recognize that modifications could be made to a protein of the present invention without diminishing its biological activity. Some modifications may be made to facilitate the cloning, expression, or incorporation of the targeting molecule into a fusion protein. Such modifications are well known to those of skill in the art and include, for example, a methionine added at the amino terminus to provide an initiation site, or additional amino acids (e.g., poly His) placed on either terminus to create conveniently located restriction sites or termination codons or purification sequences.

Expression in Prokaryotes

Prokaryotic cells may be used as hosts for expression. Prokaryotes most frequently are represented by various strains of *E. coli*; however, other microbial strains may also be used. Commonly used prokaryotic control sequences which are defined herein to include promoters for transcription initiation, optionally with an operator, along with ribosome binding site sequences, include such commonly used promoters as the beta lactamase (penicillinase) and lactose (lac) promoter systems (Chang, et al., (1977) *Nature* 198:1056), the tryptophan (trp) promoter system (Goeddel, et al., (1980) *Nucleic Acids Res.* 8:4057) and the lambda derived P L promoter and N-gene ribosome binding site (Shimatake, et al., (1981) *Nature* 292:128). The inclusion of selection markers in DNA vectors transfected in *E. coli* is also useful. Examples of such markers include genes specifying resistance to ampicillin, tetracycline, or chloramphenicol.

The vector is selected to allow introduction of the gene of interest into the appropriate host cell. Bacterial vectors are typically of plasmid or phage origin. Appropriate bacterial cells are infected with phage vector particles or transfected with naked phage vector DNA. If a plasmid vector is used, the bacterial cells are transfected with the plasmid vector DNA. Expression systems for expressing a protein of the present invention are available using *Bacillus* sp. and *Salmonella* (Palva, et al., (1983) *Gene* 22:229-35; Mosbach, et al., (1983) *Nature* 302:543-5). The pGEX-4T-1 plasmid vector from Pharmacia is the preferred *E. coli* expression vector for the present invention.

Expression in Eukaryotes

A variety of eukaryotic expression systems such as yeast, insect cell lines, plant and mammalian cells, are known to those of skill in the art. As explained briefly below, the present invention can be expressed in these eukaryotic systems. In some embodiments, transformed/transfected plant cells, as discussed infra, are employed as expression systems for production of the proteins of the instant invention.

Synthesis of heterologous proteins in yeast is well known. Sherman, et al., (1982) *Methods in Yeast Genetics*, Cold Spring Harbor Laboratory is a well recognized work describing the various methods available to produce the protein in yeast. Two widely utilized yeasts for production of eukaryotic proteins are *Saccharomyces cerevisiae* and *Pichia pastoris*. Vectors, strains, and protocols for expression in *Saccharomyces* and *Pichia* are known in the art and available from commercial suppliers (e.g., Invitrogen). Suitable vectors usually have expression control sequences, such as promoters, including 3-phosphoglycerate kinase or alcohol oxidase, and an origin of replication, termination sequences and the like as desired.

A protein of the present invention, once expressed, can be isolated from yeast by lysing the cells and applying standard protein isolation techniques to the lysates or the pellets. The monitoring of the purification process can be accomplished by using Western blot techniques or radioimmunoassay of other standard immunoassay techniques.

The sequences encoding proteins of the present invention can also be ligated to various expression vectors for use in transfecting cell cultures of, for instance, mammalian, insect, or plant origin. Mammalian cell systems often will be in the form of monolayers of cells although mammalian cell suspensions may also be used. A number of suitable host cell lines capable of expressing intact proteins have been developed in the art, and include the HEK293, BHK21, and CHO cell lines. Expression vectors for these cells can include expression control sequences, such as an origin of replication, a promoter (e.g., the CMV promoter, a HSV tk promoter or pgk (phosphoglycerate kinase) promoter), an enhancer (Queen, et al., (1986) *Immunol. Rev.* 89:49), and necessary processing information sites, such as ribosome binding sites, RNA splice sites, polyadenylation sites (e.g., an SV40 large T Ag poly A addition site), and transcriptional terminator sequences. Other animal cells useful for production of proteins of the present invention are available, for instance, from the American Type Culture Collection Catalogue of Cell Lines and Hybridomas (7$^{th}$ ed., 1992).

Appropriate vectors for expressing proteins of the present invention in insect cells are usually derived from the SF9 baculovirus. Suitable insect cell lines include mosquito larvae, silkworm, armyworm, moth, and *Drosophila* cell lines such as a Schneider cell line (see, e.g., Schneider, (1987) *J. Embryol. Exp. Morphol.* 27:353-65).

As with yeast, when higher animal or plant host cells are employed, polyadenlyation or transcription terminator sequences are typically incorporated into the vector. An example of a terminator sequence is the polyadenlyation sequence from the bovine growth hormone gene. Sequences for accurate splicing of the transcript may also be included. An example of a splicing sequence is the VP1 intron from SV40 (Sprague et al., *J. Virol.* 45:773-81 (1983)). Additionally, gene sequences to control replication in the host cell may be incorporated into the vector such as those found in bovine papilloma virus type-vectors (Saveria-Campo, "Bovine Papilloma Virus DNA a Eukaryotic Cloning Vector," in *DNA Cloning: A Practical Approach*, vol. II, Glover, ed., IRL Press, Arlington, Va., pp. 213-38 (1985)).

In addition, the NUE gene placed in the appropriate plant expression vector can be used to transform plant cells. The polypeptide can then be isolated from plant callus or the transformed cells can be used to regenerate transgenic plants. Such transgenic plants can be harvested, and the appropriate tissues (seed or leaves, for example) can be subjected to large scale protein extraction and purification techniques.

Plant Transformation Methods

Numerous methods for introducing foreign genes into plants are known and can be used to insert an NUE polynucleotide into a plant host, including biological and physical plant transformation protocols. See, e.g., Miki et al., "Procedure for Introducing Foreign DNA into Plants," in *Methods in Plant Molecular Biology and Biotechnology*, Glick and Thompson, eds., CRC Press, Inc., Boca Raton, pp. 67-88 (1993). The methods chosen vary with the host plant, and include chemical transfection methods such as calcium phosphate, microorganism-mediated gene transfer such as *Agrobacterium* (Horsch et al., *Science* 227:1229-31 (1985)), electroporation, micro-injection, and biolistic bombardment.

Expression cassettes and vectors and in vitro culture methods for plant cell or tissue transformation and regeneration of plants are known and available. See, e.g., Gruber et al., "Vectors for Plant Transformation," in *Methods in Plant Molecular Biology and Biotechnology*, supra, pp. 89-119.

The isolated polynucleotides or polypeptides may be introduced into the plant by one or more techniques typically used for direct delivery into cells. Such protocols may vary depending on the type of organism, cell, plant or plant cell, i.e. monocot or dicot, targeted for gene modification. Suitable methods of transforming plant cells include microinjection (Crossway, et al., (1986) *Biotechniques* 4:320-334; and U.S. Pat. No. 6,300,543), electroporation (Riggs, et al., (1986) *Proc. Natl. Acad. Sci. USA* 83:5602-5606, direct gene transfer (Paszkowski et al., (1984) *EMBO J.* 3:2717-2722), and ballistic particle acceleration (see, for example, Sanford, et al., U.S. Pat. No. 4,945,050; WO 91/10725; and McCabe, etal., (1988) *Biotechnology* 6:923-926). Also see, Tomes, et al., "Direct DNA Transfer into Intact Plant Cells Via Microprojectile Bombardment". pp. 197-213 in *Plant Cell, Tissue and Organ Culture, Fundamental Methods*. eds. O. L. Gamborg & G. C. Phillips. Springer-Verlag Berlin Heidelberg New York, 1995; U.S. Pat. No. 5,736,369 (meristem); Weissinger, et al., (1988) *Ann. Rev. Genet.* 22:421-477; Sanford, et al., (1987) *Particulate Science and Technology* 5:27-37 (onion); Christou, et al., (1988) *Plant Physiol.* 87:671-674 (soybean); Datta, et al., (1990) *Biotechnology* 8:736-740 (rice); Klein, et al., (1988) *Proc. Natl. Acad. Sci. USA* 85:4305-4309 (maize); Klein, et al., (1988) *Biotechnology* 6:559-563 (maize); WO 91/10725 (maize); Klein, et al., (1988) *Plant Physiol.* 91:440-444 (maize); Fromm, et al., (1990) *Biotechnology* 8:833-839; and Gordon-Kamm, et al., (1990) *Plant Cell* 2:603-618 (maize); Hooydaas-Van Slogteren & Hooykaas (1984) *Nature* (London) 311:763-764; Bytebierm, et al., (1987) *Proc. Natl. Acad. Sci. USA* 84:5345-5349 (Liliaceae); De Wet, et al., (1985) *In The Experimental Manipulation of Ovule Tissues*, ed. G. P. Chapman, et al., pp. 197-209. Longman, NY (pollen); Kaeppler, et al., (1990) *Plant Cell Reports* 9:415-418; and Kaeppler, et al., (1992) *Theor. Appl. Genet.* 84:560-566 (whisker-mediated transformation); U.S. Pat. No. 5,693,512 (sonication); D'Halluin, et al., (1992) *Plant Cell* 4:1495-1505 (electroporation); Li, et al., (1993) *Plant Cell Reports* 12:250-255; and Christou and Ford, (1995) *Annals of Botany* 75:407-413 (rice); Osjoda, et al., (1996) *Nature Biotech.* 14:745-750; *Agrobacterium* mediated maize transformation (U.S. Pat. No. 5,981,840); silicon carbide whisker methods (Frame, et al., (1994) *Plant J.* 6:941-948); laser methods (Guo, et al., (1995) *Physiologia Plantarum* 93:19-24); sonication methods (Bao, et al., (1997) *Ultrasound in Medicine & Biology* 23:953-959; Finer and Finer, (2000) *Lett Appl Microbiol.* 30:406-10; Amoah, et al., (2001) *J Exp Bot* 52:1135-42); polyethylene glycol methods (Krens, et al., (1982) *Nature* 296:72-77); protoplasts of monocot and dicot cells can be transformed using electroporation (Fromm, et al., (1985) *Proc. Natl. Acad. Sci. USA* 82:5824-5828) and microinjection (Crossway, et al., (1986) *Mol. Gen. Genet.* 202:179-185); all of which are herein incorporated by reference.

*Agrobacterium*-mediated Transformation

The most widely utilized method for introducing an expression vector into plants is based on the natural transformation system of *Agrobacterium*. *A. tumefaciens* and *A. rhizogenes* are plant pathogenic soil bacteria, which genetically transform plant cells. The Ti and Ri plasmids of *A. tumefaciens* and *A. rhizogenes*, respectively, carry genes responsible for genetic transformation of plants. See, e.g., Kado, (1991) *Crit. Rev. Plant Sci.* 10:1. Descriptions of the *Agrobacterium* vector systems and methods for *Agrobacterium*-mediated gene transfer are provided in Gruber, et al., supra; Miki, et al., supra; and Moloney, et al., (1989) *Plant Cell Reports* 8:238.

Similarly, the gene can be inserted into the T-DNA region of a Ti or Ri plasmid derived from *A. tumefaciens* or *A. rhizogenes*, respectively. Thus, expression cassettes can be constructed as above, using these plasmids. Many control sequences are known which when coupled to a heterologous coding sequence and transformed into a host organism show fidelity in gene expression with respect to tissue/organ specificity of the original coding sequence. See, e.g., Benfey and Chua, (1989) *Science* 244:174-81. Particularly suitable control sequences for use in these plasmids are promoters for constitutive leaf-specific expression of the gene in the various target plants. Other useful control sequences include a promoter and terminator from the nopaline synthase gene (NOS). The NOS promoter and terminator are present in the plasmid pARC2, available from the American Type Culture Collection and designated ATCC 67238. If such a system is used, the virulence (vir) gene from either the Ti or Ri plasmid must also be present, either along with the T-DNA portion, or via a binary system where the vir gene is present on a separate vector. Such systems, vectors for use therein, and methods of transforming plant cells are described in U.S. Pat. No. 4,658,082; U.S. patent application Ser. No. 913,914, filed Oct. 1, 1986, as referenced in U.S. Pat. No. 5,262,306, issued Nov. 16, 1993; and Simpson, et al., (1986) *Plant Mol. Biol.* 6:403-15 (also referenced in the '306 patent); all incorporated by reference in their entirety.

Once constructed, these plasmids can be placed into *A. rhizogenes* or *A. tumefaciens* and these vectors used to transform cells of plant species, which are ordinarily susceptible to *Fusarium* or *Alternaria* infection. Several other transgenic plants are also contemplated by the present invention including but not limited to soybean, corn, sorghum, alfalfa, rice, clover, cabbage, banana, coffee, celery, tobacco, cowpea, cotton, melon and pepper. The selection of either *A. tumefaciens* or *A. rhizogenes* will depend on the plant being transformed thereby. In general *A. tumefaciens* is the preferred organism for transformation. Most dicotyledonous plants, some gymnosperms, and a few monocotyledonous plants (e.g., certain members of the Liliales and Arales) are susceptible to infection with *A. tumefaciens. A. rhizogenes* also has a wide host range, embracing most dicots and some gymnosperms, which includes members of the *Leguminosae, Compositae*, and *Chenopodiaceae*. Monocot plants can now be transformed with some success. European Patent Application No. 604 662 A1 discloses a method for transforming monocots using *Agrobacterium*. European Application No. 672 752 A1 discloses a method for transforming monocots with *Agrobacterium* using the scutellum of immature embryos. Ishida, et al., discuss a method for transforming maize by exposing immature embryos to *A. tumefaciens* (*Nature Biotechnology* 14:745-50 (1996)).

Once transformed, these cells can be used to regenerate transgenic plants. For example, whole plants can be infected with these vectors by wounding the plant and then introducing the vector into the wound site. Any part of the plant can be wounded, including leaves, stems and roots. Alternatively, plant tissue, in the form of an explant, such as cotyledonary tissue or leaf disks, can be inoculated with these vectors, and cultured under conditions, which promote plant regeneration. Roots or shoots transformed by inoculation of plant tissue with *A. rhizogenes* or *A. tumefaciens*, containing the gene coding for the fumonisin degradation enzyme, can be used as a source of plant tissue to regenerate fumonisin-resistant transgenic plants, either via somatic embryogenesis or organogenesis. Examples of such methods for regenerating plant tissue are disclosed in Shahin, (1985) *Theor. Appl. Genet.* 69:235-40; U.S. Pat. No. 4,658,082; Simpson, et al., supra; and U.S. patent application Ser. Nos. 913,913 and 913,914, both filed Oct. 1, 1986, as referenced in U.S. Pat. No. 5,262,306, issued Nov. 16, 1993, the entire disclosures therein incorporated herein by reference.

Direct Gene Transfer

Despite the fact that the host range for *Agrobacterium*-mediated transformation is broad, some major cereal crop species and gymnosperms have generally been recalcitrant to this mode of gene transfer, even though some success has recently been achieved in rice (Hiei, et al., (1994) *The Plant Journal* 6:271-82). Several methods of plant transformation, collectively referred to as direct gene transfer, have been developed as an alternative to *Agrobacterium*-mediated transformation.

A generally applicable method of plant transformation is microprojectile-mediated transformation, where DNA is carried on the surface of microprojectiles measuring about 1 to 4 μm. The expression vector is introduced into plant tissues with a biolistic device that accelerates the microprojectiles to speeds of 300 to 600 m/s which is sufficient to penetrate the plant cell walls and membranes (Sanford, et al., (1987) *Part. Sci. Technol.* 5:27; Sanford, (1988) *Trends Biotech* 6:299; Sanford, (1990) *Physiol. Plant* 79:206; and Klein, et al., (1992) *Biotechnology* 10:268).

Another method for physical delivery of DNA to plants is sonication of target cells as described in Zang, et al., (1991) *BioTechnology* 9:996. Alternatively, liposome or spheroplast fusions have been used to introduce expression vectors into plants. See, e.g., Deshayes, et al., (1985) *EMBO J.* 4:2731; and Christou, et al., (1987) *Proc. Natl. Acad. Sci. USA* 84:3962. Direct uptake of DNA into protoplasts using $CaCl_2$ precipitation, polyvinyl alcohol, or poly-L-ornithine has also been reported. See, e.g., Hain, et al., (1985) *Mol. Gen. Genet.* 199:161; and Draper, et al., (1982) *Plant Cell Physiol.* 23:451.

Electroporation of protoplasts and whole cells and tissues has also been described. See, e.g., Donn, et al., (1990) *Abstracts of the VIIth Int'l. Congress on Plant Cell and Tissue Culture IAPTC*, A2-38, p. 53; D'Halluin, et al., (1992) *Plant Cell* 4:1495-505; and Spencer, et al., (1994) *Plant Mol. Biol.* 24:51-61.

Increasing the Activity and/or Level of a NUE Polypeptide

Methods are provided to increase the activity and/or level of the NUE polypeptide of the invention. An increase in the level and/or activity of the NUE polypeptide of the invention can be achieved by providing to the plant a NUE polypeptide. The NUE polypeptide can be provided by introducing the amino acid sequence encoding the NUE polypeptide into the plant, introducing into the plant a nucleotide sequence encoding a NUE polypeptide or alternatively by modifying a genomic locus encoding the NUE polypeptide of the invention.

As discussed elsewhere herein, many methods are known the art for providing a polypeptide to a plant including, but not limited to, direct introduction of the polypeptide into the plant, introducing into the plant (transiently or stably) a polynucleotide construct encoding a polypeptide having enhanced nitrogen utilization activity. It is also recognized that the methods of the invention may employ a polynucleotide that is not capable of directing, in the transformed plant, the expression of a protein or an RNA. Thus, the level and/or activity of a NUE polypeptide may be increased by altering the gene encoding the NUE polypeptide or its promoter. See, e.g., Kmiec, U.S. Pat. No. 5,565,350; Zarling, et al., PCT/US93/03868. Therefore mutagenized plants that carry mutations in NUE genes, where the mutations increase expression of the NUE gene or increase the NUE activity of the encoded NUE polypeptide are provided.

Reducing the Activity and/or Level of a NUE Polypeptide

Methods are provided to reduce or eliminate the activity of a NUE polypeptide of the invention by transforming a plant cell with an expression cassette that expresses a polynucleotide that inhibits the expression of the NUE polypeptide. The polynucleotide may inhibit the expression of the NUE polypeptide directly, by preventing transcription or translation of the NUE messenger RNA, or indirectly, by encoding a polypeptide that inhibits the transcription or translation of an NUE gene encoding NUE polypeptide. Methods for inhibiting or eliminating the expression of a gene in a plant are well known in the art, and any such method may be used in the present invention to inhibit the expression of NUE polypeptide.

In accordance with the present invention, the expression of NUE polypeptide is inhibited if the protein level of the NUE polypeptide is less than 70% of the protein level of the same NUE polypeptide in a plant that has not been genetically modified or mutagenized to inhibit the expression of that NUE polypeptide. In particular embodiments of the invention, the protein level of the NUE polypeptide in a modified plant according to the invention is less than 60%, less than 50%, less than 40%, less than 30%, less than 20%, less than 10%, less than 5%, or less than 2% of the protein level of the same NUE polypeptide in a plant that is not a mutant or that has not been genetically modified to inhibit the expression of that NUE polypeptide. The expression level of the NUE polypeptide may be measured directly, for example, by assaying for the level of NUE polypeptide expressed in the plant cell or plant, or indirectly, for example, by measuring the nitrogen uptake activity of the NUE polypeptide in the plant cell or plant, or by measuring the phenotypic changes in the plant. Methods for performing such assays are described elsewhere herein.

In other embodiments of the invention, the activity of the NUE polypeptides is reduced or eliminated by transforming a plant cell with an expression cassette comprising a polynucleotide encoding a polypeptide that inhibits the activity of a NUE polypeptide. The enhanced nitrogen utilization activity of a NUE polypeptide is inhibited according to the present invention if the NUE activity of the NUE polypeptide is less than 70% of the NUE activity of the same NUE polypeptide in a plant that has not been modified to inhibit the NUE activity of that NUE polypeptide. In particular embodiments of the invention, the NUE activity of the NUE polypeptide in a modified plant according to the invention is less than 60%, less than 50%, less than 40%, less than 30%, less than 20%, less than 10%, or less than 5% of the NUE activity of the same NUE polypeptide in a plant that that has not been modified to inhibit the expression of that NUE polypeptide. The NUE activity of a NUE polypeptide is "eliminated" according to the invention when it is not detectable by the assay methods described elsewhere herein. Methods of determining the alteration of nitrogen utilization activity of a NUE polypeptide are described elsewhere herein.

In other embodiments, the activity of a NUE polypeptide may be reduced or eliminated by disrupting the gene encoding the NUE polypeptide. The invention encompasses mutagenized plants that carry mutations in NUE genes, where the mutations reduce expression of the NUE gene or inhibit the nitrogen utilization activity of the encoded NUE polypeptide.

Thus, many methods may be used to reduce or eliminate the activity of a NUE polypeptide. In addition, more than one method may be used to reduce the activity of a single NUE polypeptide.

1. Polynucleotide-Based Methods:

In some embodiments of the present invention, a plant is transformed with an expression cassette that is capable of expressing a polynucleotide that inhibits the expression of an NUE polypeptide of the invention. The term "expression" as used herein refers to the biosynthesis of a gene product, including the transcription and/or translation of said gene product. For example, for the purposes of the present invention, an expression cassette capable of expressing a polynucleotide that inhibits the expression of at least one NUE polypeptide is an expression cassette capable of producing an RNA molecule that inhibits the transcription and/or translation of at least one NUE polypeptide of the invention. The "expression" or "production" of a protein or polypeptide from a DNA molecule refers to the transcription and translation of the coding sequence to produce the protein or polypeptide, while the "expression" or "production" of a protein or polypeptide from an RNA molecule refers to the translation of the RNA coding sequence to produce the protein or polypeptide.

Examples of polynucleotides that inhibit the expression of a NUE polypeptide are given below.

i. Sense Suppression/Cosuppression

In some embodiments of the invention, inhibition of the expression of a NUE polypeptide may be obtained by sense suppression or cosuppression. For cosuppression, an expression cassette is designed to express an RNA molecule corresponding to all or part of a messenger RNA encoding a NUE polypeptide in the "sense" orientation. Over expression of the RNA molecule can result in reduced expression of the native gene. Accordingly, multiple plant lines transformed with the cosuppression expression cassette are screened to identify those that show the greatest inhibition of NUE polypeptide expression.

The polynucleotide used for cosuppression may correspond to all or part of the sequence encoding the NUE polypeptide, all or part of the 5' and/or 3' untranslated region of a NUE polypeptide transcript, or all or part of both the coding sequence and the untranslated regions of a transcript encoding a NUE polypeptide. In some embodiments where the polynucleotide comprises all or part of the coding region for the NUE polypeptide, the expression cassette is designed to eliminate the start codon of the polynucleotide so that no protein product will be translated.

Cosuppression may be used to inhibit the expression of plant genes to produce plants having undetectable protein levels for the proteins encoded by these genes. See, for example, Broin, et al., (2002) *Plant Cell* 14:1417-1432. Cosuppression may also be used to inhibit the expression of multiple proteins in the same plant. See, for example, U.S. Pat. No. 5,942,657. Methods for using cosuppression to inhibit the expression of endogenous genes in plants are described in Flavell, et al., (1994) *Proc. Natl. Acad. Sci. USA* 91:3490-3496; Jorgensen, et al., (1996) *Plant Mol. Biol.* 31:957-973; Johansen and Carrington, (2001) *Plant Physiol.* 126:930-938; Broin, et al., (2002) *Plant Cell* 14:1417-1432; Stoutjesdijk, et al., (2002) *Plant Physiol.* 129:1723-1731; Yu, et al., (2003) *Phytochemistry* 63:753-763; and U.S. Pat. Nos. 5,034,323, 5,283,184, and 5,942,657; each of which is herein incorporated by reference. The efficiency of cosuppression may be increased by including a poly-dT region in the expression cassette at a position 3' to the sense sequence and 5' of the polyadenylation signal. See, U.S. Patent Publication No. 20020048814, herein incorporated by reference. Typically, such a nucleotide sequence has substantial sequence identity to the sequence of the transcript of the endogenous gene, optimally greater than about 65% sequence identity, more optimally greater than about 85% sequence identity, most optimally greater than about 95% sequence identity. See U.S. Pat. Nos. 5,283,184 and 5,034,323; herein incorporated by reference.

ii. Antisense Suppression

In some embodiments of the invention, inhibition of the expression of the NUE polypeptide may be obtained by antisense suppression. For antisense suppression, the expression cassette is designed to express an RNA molecule complementary to all or part of a messenger RNA encoding the NUE polypeptide. Over expression of the antisense RNA molecule can result in reduced expression of the native gene. Accordingly, multiple plant lines transformed with the antisense suppression expression cassette are screened to identify those that show the greatest inhibition of NUE polypeptide expression.

The polynucleotide for use in antisense suppression may correspond to all or part of the complement of the sequence encoding the NUE polypeptide, all or part of the complement of the 5' and/or 3' untranslated region of the NUE transcript, or all or part of the complement of both the coding sequence and the untranslated regions of a transcript encoding the NUE polypeptide. In addition, the antisense polynucleotide may be fully complementary (i.e., 100% identical to the complement of the target sequence) or partially complementary (i.e., less than 100% identical to the complement of the target sequence) to the target sequence. Antisense suppression may be used to inhibit the expression of multiple proteins in the same plant. See, for example, U.S. Pat. No. 5,942,657. Furthermore, portions of the antisense nucleotides may be used to disrupt the expression of the target gene. Generally, sequences of at least 50 nucleotides, 100 nucleotides, 200 nucleotides, 300, 400, 450, 500, 550, or greater may be used. Methods for using antisense suppression to inhibit the expression of endogenous genes in plants are described, for example, in Liu, et al., (2002) *Plant Physiol.* 129:1732-1743 and U.S. Pat. Nos. 5,759,829 and 5,942,657, each of which is herein incorporated by reference. Efficiency of antisense suppression may be increased by including a poly-dT region in the expression cassette at a position 3' to the antisense sequence and 5' of the polyadenylation signal. See, U.S. Patent Publication No. 20020048814, herein incorporated by reference.

iii. Double-Stranded RNA Interference

In some embodiments of the invention, inhibition of the expression of a NUE polypeptide may be obtained by double-stranded RNA (dsRNA) interference. For dsRNA interference, a sense RNA molecule like that described above for cosuppression and an antisense RNA molecule that is fully or partially complementary to the sense RNA molecule are expressed in the same cell, resulting in inhibition of the expression of the corresponding endogenous messenger RNA.

Expression of the sense and antisense molecules can be accomplished by designing the expression cassette to comprise both a sense sequence and an antisense sequence. Alternatively, separate expression cassettes may be used for the sense and antisense sequences. Multiple plant lines transformed with the dsRNA interference expression cassette or expression cassettes are then screened to identify plant lines that show the greatest inhibition of NUE polypeptide expression. Methods for using dsRNA interference to inhibit the expression of endogenous plant genes are described in Waterhouse, et al., (1998) *Proc. Natl. Acad. Sci. USA* 95:13959-13964, Liu, et al., (2002) *Plant Physiol.* 129:1732-1743, and WO 99/49029, WO 99/53050, WO 99/61631, and WO 00/49035; each of which is herein incorporated by reference.

iv. Hairpin RNA Interference and Intron-Containing Hairpin RNA Interference

In some embodiments of the invention, inhibition of the expression of a NUE polypeptide may be obtained by hairpin RNA (hpRNA) interference or intron-containing hairpin RNA (ihpRNA) interference. These methods are highly efficient at inhibiting the expression of endogenous genes. See, Waterhouse and Helliwell, (2003) *Nat. Rev. Genet.* 4:29-38 and the references cited therein.

For hpRNA interference, the expression cassette is designed to express an RNA molecule that hybridizes with itself to form a hairpin structure that comprises a single-stranded loop region and a base-paired stem. The base-paired stem region comprises a sense sequence corresponding to all or part of the endogenous messenger RNA encoding the gene whose expression is to be inhibited, and an antisense sequence that is fully or partially complementary to the sense sequence. Alternatively, the base-paired stem region may correspond to a portion of a promoter sequence controlling expression of the gene to be inhibited. Thus, the base-paired stem region of the molecule generally determines the specificity of the RNA interference. hpRNA molecules are highly efficient at inhibiting the expression of endogenous genes, and the RNA interference they induce is inherited by subsequent generations of plants. See, for example, Chuang and Meyerowitz, (2000) *Proc. Natl. Acad. Sci. USA* 97:4985-4990; Stoutjesdijk, et al., (2002) *Plant Physiol.* 129:1723-1731; and Waterhouse and Helliwell, (2003) *Nat. Rev. Genet.* 4:29-38. Methods for using hpRNA interference to inhibit or silence the expression of genes are described, for example, in Chuang and Meyerowitz, (2000) *Proc. Natl. Acad. Sci. USA* 97:4985-4990; Stoutjesdijk, et al., (2002) *Plant Physiol.* 129: 1723-1731; Waterhouse and Helliwell, (2003) *Nat. Rev. Genet.* 4:29-38; Pandolfini et al., *BMC Biotechnology* 3:7, and U.S. Patent Publication No. 2003/0175965; each of which is herein incorporated by reference. A transient assay for the efficiency of hpRNA constructs to silence gene expression in vivo has been described by Panstruga, et al., (2003) *Mol. Biol. Rep.* 30:135-140, herein incorporated by reference.

For ihpRNA, the interfering molecules have the same general structure as for hpRNA, but the RNA molecule additionally comprises an intron that is capable of being spliced in the cell in which the ihpRNA is expressed. The use of an intron minimizes the size of the loop in the hairpin RNA molecule following splicing, and this increases the efficiency of interference. See, for example, Smith, et al., (2000) *Nature* 407: 319-320. In fact, Smith, et al., show 100% suppression of endogenous gene expression using ihpRNA-mediated interference. Methods for using ihpRNA interference to inhibit the expression of endogenous plant genes are described, for example, in Smith, et al., (2000) *Nature* 407:319-320; Wesley, et al., (2001) *Plant J.* 27:581-590; Wang and Waterhouse, (2001) *Curr. Opin. Plant Biol.* 5:146-150; Waterhouse and Helliwell, (2003) *Nat. Rev. Genet.* 4:29-38; Helliwell and Waterhouse, (2003) *Methods* 30:289-295, and U.S. Patent Publication No. 2003/0180945, each of which is herein incorporated by reference.

The expression cassette for hpRNA interference may also be designed such that the sense sequence and the antisense sequence do not correspond to an endogenous RNA. In this embodiment, the sense and antisense sequence flank a loop sequence that comprises a nucleotide sequence corresponding to all or part of the endogenous messenger RNA of the target gene. Thus, it is the loop region that determines the specificity of the RNA interference. See, for example, WO 02/00904; Mette, et al., (2000) *EMBO J* 19:5194-5201; Matzke, et al., (2001) *Curr. Opin. Genet. Devel.* 11:221-227; Scheid, et al., (2002) *Proc. Natl. Acad. Sci., USA* 99:13659-13662; Aufsaftz, et al., (2002) *Proc. Nat'l. Acad. Sci.* 99(4): 16499-16506; Sijen, et al., *Curr. Biol.* (2001) 11:436-440), herein incorporated by reference.

v. Amplicon-Mediated Interference

Amplicon expression cassettes comprise a plant virus-derived sequence that contains all or part of the target gene but generally not all of the genes of the native virus. The viral sequences present in the transcription product of the expression cassette allow the transcription product to direct its own replication. The transcripts produced by the amplicon may be either sense or antisense relative to the target sequence (i.e., the messenger RNA for the NUE polypeptide). Methods of using amplicons to inhibit the expression of endogenous plant genes are described, for example, in Angell and Baulcombe, (1997) *EMBO J.* 16:3675-3684, Angell and Baulcombe, (1999) *Plant J.* 20:357-362, and U.S. Pat. No. 6,646,805, each of which is herein incorporated by reference.

vi. Ribozymes

In some embodiments, the polynucleotide expressed by the expression cassette of the invention is catalytic RNA or has ribozyme activity specific for the messenger RNA of the NUE polypeptide. Thus, the polynucleotide causes the degradation of the endogenous messenger RNA, resulting in reduced expression of the NUE polypeptide. This method is described, for example, in U.S. Pat. No. 4,987,071, herein incorporated by reference.

vii. Small Interfering RNA or Micro RNA

In some embodiments of the invention, inhibition of the expression of a NUE polypeptide may be obtained by RNA interference by expression of a gene encoding a micro RNA (miRNA). miRNAs are regulatory agents consisting of about 22 ribonucleotides. miRNA are highly efficient at inhibiting the expression of endogenous genes. See, for example Javier, et al., (2003) *Nature* 425:257-263, herein incorporated by reference.

For miRNA interference, the expression cassette is designed to express an RNA molecule that is modeled on an endogenous miRNA gene. The miRNA gene encodes an RNA that forms a hairpin structure containing a 22-nucleotide sequence that is complementary to another endogenous gene (target sequence). For suppression of NUE expression, the 22-nucleotide sequence is selected from a NUE transcript sequence and contains 22 nucleotides of said NUE sequence in sense orientation and 21 nucleotides of a corresponding antisense sequence that is complementary to the sense sequence. miRNA molecules are highly efficient at inhibiting the expression of endogenous genes, and the RNA interference they induce is inherited by subsequent generations of plants.

2. Polypeptide-Based Inhibition of Gene Expression

In one embodiment, the polynucleotide encodes a zinc finger protein that binds to a gene encoding a NUE polypeptide, resulting in reduced expression of the gene. In particular embodiments, the zinc finger protein binds to a regulatory region of a NUE gene. In other embodiments, the zinc finger protein binds to a messenger RNA encoding a NUE polypeptide and prevents its translation. Methods of selecting sites for targeting by zinc finger proteins have been described, for example, in U.S. Pat. No. 6,453,242, and methods for using zinc finger proteins to inhibit the expression of genes in plants are described, for example, in U.S. Patent Publication No. 2003/0037355; each of which is herein incorporated by reference.

3. Polypeptide-Based Inhibition of Protein Activity

In some embodiments of the invention, the polynucleotide encodes an antibody that binds to at least one NUE polypeptide, and reduces the enhanced nitrogen utilization activity of the NUE polypeptide. In another embodiment, the binding of the antibody results in increased turnover of the antibody-NUE complex by cellular quality control mechanisms. The expression of antibodies in plant cells and the inhibition of molecular pathways by expression and binding of antibodies to proteins in plant cells are well known in the art. See, for example, Conrad and Sonnewald, (2003) *Nature Biotech.* 21:35-36, incorporated herein by reference.

4. Gene Disruption

In some embodiments of the present invention, the activity of a NUE polypeptide is reduced or eliminated by disrupting the gene encoding the NUE polypeptide. The gene encoding the NUE polypeptide may be disrupted by any method known in the art. For example, in one embodiment, the gene is disrupted by transposon tagging. In another embodiment, the gene is disrupted by mutagenizing plants using random or targeted mutagenesis, and selecting for plants that have reduced nitrogen utilization activity.

i. Transposon Tagging

In one embodiment of the invention, transposon tagging is used to reduce or eliminate the NUE activity of one or more NUE polypeptide. Transposon tagging comprises inserting a transposon within an endogenous NUE gene to reduce or eliminate expression of the NUE polypeptide. "NUE gene" is intended to mean the gene that encodes a NUE polypeptide according to the invention.

In this embodiment, the expression of one or more NUE polypeptide is reduced or eliminated by inserting a transposon within a regulatory region or coding region of the gene encoding the NUE polypeptide. A transposon that is within an exon, intron, 5' or 3' untranslated sequence, a promoter, or any other regulatory sequence of a NUE gene may be used to reduce or eliminate the expression and/or activity of the encoded NUE polypeptide.

Methods for the transposon tagging of specific genes in plants are well known in the art. See, for example, Maes, et al., (1999) *Trends Plant Sci.* 4:90-96; Dharmapuri and Sonti, (1999) *FEMS Microbiol. Lett.* 179:53-59; Meissner, et al., (2000) *Plant J.* 22:265-274; Phogat, et al., (2000) *J. Biosci.* 25:57-63; Walbot, (2000) *Curr. Opin. Plant Biol.* 2:103-107; Gai, et al., (2000) *Nucleic Acids Res.* 28:94-96; Fitzmaurice, et al., (1999) *Genetics* 153:1919-1928). In addition, the TUSC process for selecting Mu insertions in selected genes has been described in Bensen, et al., (1995) *Plant Cell* 7:75-84; Mena, et al., (1996) *Science* 274:1537-1540; and U.S. Pat. No. 5,962,764; each of which is herein incorporated by reference.

ii. Mutant Plants with Reduced Activity

Additional methods for decreasing or eliminating the expression of endogenous genes in plants are also known in the art and can be similarly applied to the instant invention. These methods include other forms of mutagenesis, such as ethyl methanesulfonate-induced mutagenesis, deletion mutagenesis, and fast neutron deletion mutagenesis used in a reverse genetics sense (with PCR) to identify plant lines in which the endogenous gene has been deleted. For examples of these methods see, Ohshima, et al., (1998) *Virology* 243: 472-481; Okubara, et al., (1994) *Genetics* 137:867-874; and Quesada, et al., (2000) *Genetics* 154:421-436; each of which is herein incorporated by reference. In addition, a fast and automatable method for screening for chemically induced mutations, TILLING (Targeting Induced Local Lesions In Genomes), using denaturing HPLC or selective endonuclease digestion of selected PCR products is also applicable to the instant invention. See, McCallum, et al., (2000) *Nat. Biotechnol.* 18:455-457, herein incorporated by reference.

Mutations that impact gene expression or that interfere with the function (enhanced nitrogen utilization activity) of the encoded protein are well known in the art. Insertional mutations in gene exons usually result in null-mutants. Mutations in conserved residues are particularly effective in inhibiting the activity of the encoded protein. Conserved residues of plant NUE polypeptides suitable for mutagenesis with the goal to eliminate NUE activity have been described. Such mutants can be isolated according to well-known procedures, and mutations in different NUE loci can be stacked by genetic crossing. See, for example, Gruis, et al., (2002) *Plant Cell* 14:2863-2882.

In another embodiment of this invention, dominant mutants can be used to trigger RNA silencing due to gene inversion and recombination of a duplicated gene locus. See, for example, Kusaba, et al., (2003) *Plant Cell* 15:1455-1467.

The invention encompasses additional methods for reducing or eliminating the activity of one or more NUE polypeptide. Examples of other methods for altering or mutating a genomic nucleotide sequence in a plant are known in the art and include, but are not limited to, the use of RNA:DNA vectors, RNA:DNA mutational vectors, RNA:DNA repair vectors, mixed-duplex oligonucleotides, self-complementary RNA:DNA oligonucleotides, and recombinogenic oligonucleobases. Such vectors and methods of use are known in the art. See, for example, U.S. Pat. Nos. 5,565,350; 5,731,181; 5,756,325; 5,760,012; 5,795,972; and 5,871,984; each of which are herein incorporated by reference. See also, WO 98/49350, WO 99/07865, WO 99/25821, and Beetham, et al., (1999) *Proc. Natl. Acad. Sci. USA* 96:8774-8778; each of which is herein incorporated by reference.

iii. Modulating Nitrogen Utilization Activity

In specific methods, the level and/or activity of a NUE regulator in a plant is decreased by increasing the level or activity of the NUE polypeptide in the plant. The increased expression of a negative regulatory molecule may decrease the level of expression of downstream one or more genes responsible for an improved NUE phenotype.

Methods for increasing the level and/or activity of NUE polypeptides in a plant are discussed elsewhere herein. Briefly, such methods comprise providing a NUE polypeptide of the invention to a plant and thereby increasing the level and/or activity of the NUE polypeptide. In other embodiments, a NUE nucleotide sequence encoding a NUE polypeptide can be provided by introducing into the plant a polynucleotide comprising a NUE nucleotide sequence of the invention, expressing the NUE sequence, increasing the activity of the NUE polypeptide, and thereby decreasing the number of tissue cells in the plant or plant part. In other embodiments, the NUE nucleotide construct introduced into the plant is stably incorporated into the genome of the plant.

In other methods, the growth of a plant tissue is increased by decreasing the level and/or activity of the NUE polypeptide in the plant. Such methods are disclosed in detail elsewhere herein. In one such method, a NUE nucleotide sequence is introduced into the plant and expression of said NUE nucleotide sequence decreases the activity of the NUE polypeptide, and thereby increasing the tissue growth in the plant or plant part. In other embodiments, the NUE nucleotide construct introduced into the plant is stably incorporated into the genome of the plant.

As discussed above, one of skill will recognize the appropriate promoter to use to modulate the level/activity of a NUE in the plant. Exemplary promoters for this embodiment have been disclosed elsewhere herein.

In other embodiments, such plants have stably incorporated into their genome a nucleic acid molecule comprising a NUE nucleotide sequence of the invention operably linked to a promoter that drives expression in the plant cell.

iv. Modulating Root Development

Methods for modulating root development in a plant are provided. By "modulating root development" is intended any alteration in the development of the plant root when compared to a control plant. Such alterations in root development include, but are not limited to, alterations in the growth rate of the primary root, the fresh root weight, the extent of lateral and adventitious root formation, the vasculature system, meristem development, or radial expansion.

Methods for modulating root development in a plant are provided. The methods comprise modulating the level and/or activity of the NUE polypeptide in the plant. In one method, a NUE sequence of the invention is provided to the plant. In another method, the NUE nucleotide sequence is provided by introducing into the plant a polynucleotide comprising a NUE nucleotide sequence of the invention, expressing the NUE sequence, and thereby modifying root development. In still other methods, the NUE nucleotide construct introduced into the plant is stably incorporated into the genome of the plant.

In other methods, root development is modulated by altering the level or activity of the NUE polypeptide in the plant. A change in NUE activity can result in at least one or more of the following alterations to root development, including, but not limited to, alterations in root biomass and length.

As used herein, "root growth" encompasses all aspects of growth of the different parts that make up the root system at different stages of its development in both monocotyledonous and dicotyledonous plants. It is to be understood that enhanced root growth can result from enhanced growth of one or more of its parts including the primary root, lateral roots, adventitious roots, etc.

Methods of measuring such developmental alterations in the root system are known in the art. See, for example, U.S. Application No. 2003/0074698 and Werner, et al., (2001) *PNAS* 18:10487-10492, both of which are herein incorporated by reference.

As discussed above, one of skill will recognize the appropriate promoter to use to modulate root development in the plant. Exemplary promoters for this embodiment include constitutive promoters and root-preferred promoters. Exemplary root-preferred promoters have been disclosed elsewhere herein.

Stimulating root growth and increasing root mass by decreasing the activity and/or level of the NUE polypeptide also finds use in improving the standability of a plant. The term "resistance to lodging" or "standability" refers to the ability of a plant to fix itself to the soil. For plants with an erect or semi-erect growth habit, this term also refers to the ability to maintain an upright position under adverse (environmental) conditions. This trait relates to the size, depth and morphology of the root system. In addition, stimulating root growth and increasing root mass by altering the level and/or activity of the NUE polypeptide also finds use in promoting in vitro propagation of explants.

Furthermore, higher root biomass production due to NUE activity has a direct effect on the yield and an indirect effect of production of compounds produced by root cells or transgenic root cells or cell cultures of said transgenic root cells. One example of an interesting compound produced in root cultures is shikonin, the yield of which can be advantageously enhanced by said methods.

Accordingly, the present invention further provides plants having modulated root development when compared to the root development of a control plant. In some embodiments, the plant of the invention has an increased level/activity of the NUE polypeptide of the invention and has enhanced root growth and/or root biomass. In other embodiments, such plants have stably incorporated into their genome a nucleic acid molecule comprising a NUE nucleotide sequence of the invention operably linked to a promoter that drives expression in the plant cell.

v. Modulating Shoot and Leaf Development

Methods are also provided for modulating shoot and leaf development in a plant. By "modulating shoot and/or leaf development" is intended any alteration in the development of the plant shoot and/or leaf. Such alterations in shoot and/or leaf development include, but are not limited to, alterations in shoot meristem development, in leaf number, leaf size, leaf and stem vasculature, internode length, and leaf senescence. As used herein, "leaf development" and "shoot development" encompasses all aspects of growth of the different parts that make up the leaf system and the shoot system, respectively, at different stages of their development, both in monocotyledonous and dicotyledonous plants. Methods for measuring such developmental alterations in the shoot and leaf system are known in the art. See, for example, Werner, et al., (2001) *PNAS* 98:10487-10492 and U.S. Application No. 2003/0074698, each of which is herein incorporated by reference.

The method for modulating shoot and/or leaf development in a plant comprises modulating the activity and/or level of a NUE polypeptide of the invention. In one embodiment, a NUE sequence of the invention is provided. In other embodiments, the NUE nucleotide sequence can be provided by introducing into the plant a polynucleotide comprising a NUE nucleotide sequence of the invention, expressing the NUE sequence, and thereby modifying shoot and/or leaf development. In other embodiments, the NUE nucleotide construct introduced into the plant is stably incorporated into the genome of the plant.

In specific embodiments, shoot or leaf development is modulated by altering the level and/or activity of the NUE polypeptide in the plant. A change in NUE activity can result in at least one or more of the following alterations in shoot and/or leaf development, including, but not limited to, changes in leaf number, altered leaf surface, altered vasculature, internodes and plant growth, and alterations in leaf senescence, when compared to a control plant.

As discussed above, one of skill will recognize the appropriate promoter to use to modulate shoot and leaf development of the plant. Exemplary promoters for this embodiment include constitutive promoters, shoot-preferred promoters, shoot meristem-preferred promoters, and leaf-preferred promoters. Exemplary promoters have been disclosed elsewhere herein.

Increasing NUE activity and/or level in a plant results in altered internodes and growth. Thus, the methods of the invention find use in producing modified plants. In addition, as discussed above, NUE activity in the plant modulates both root and shoot growth. Thus, the present invention further provides methods for altering the root/shoot ratio. Shoot or leaf development can further be modulated by altering the level and/or activity of the NUE polypeptide in the plant.

Accordingly, the present invention further provides plants having modulated shoot and/or leaf development when compared to a control plant. In some embodiments, the plant of the invention has an increased level/activity of the NUE polypeptide of the invention. In other embodiments, the plant of the invention has a decreased level/activity of the NUE polypeptide of the invention.

vi. Modulating Reproductive Tissue Development

Methods for modulating reproductive tissue development are provided. In one embodiment, methods are provided to modulate floral development in a plant. By "modulating floral development" is intended any alteration in a structure of a plant's reproductive tissue as compared to a control plant in which the activity or level of the NUE polypeptide has not been modulated. "Modulating floral development" further includes any alteration in the timing of the development of a plant's reproductive tissue (i.e., a delayed or a accelerated timing of floral development) when compared to a control plant in which the activity or level of the NUE polypeptide has not been modulated. Macroscopic alterations may include changes in size, shape, number, or location of reproductive organs, the developmental time period that these structures form, or the ability to maintain or proceed through the flowering process in times of environmental stress. Microscopic alterations may include changes to the types or shapes of cells that make up the reproductive organs.

The method for modulating floral development in a plant comprises modulating NUE activity in a plant. In one method, a NUE sequence of the invention is provided. A NUE nucleotide sequence can be provided by introducing into the plant a polynucleotide comprising a NUE nucleotide sequence of the invention, expressing the NUE sequence, and thereby modifying floral development. In other embodiments, the NUE nucleotide construct introduced into the plant is stably incorporated into the genome of the plant.

In specific methods, floral development is modulated by increasing the level or activity of the NUE polypeptide in the plant. A change in NUE activity can result in at least one or more of the following alterations in floral development, including, but not limited to, altered flowering, changed number of flowers, modified male sterility, and altered seed set, when compared to a control plant. Inducing delayed flowering or inhibiting flowering can be used to enhance yield in forage crops such as alfalfa. Methods for measuring such developmental alterations in floral development are known in the art. See, for example, Mouradov, et al., (2002) *The Plant Cell* S111-S130, herein incorporated by reference.

As discussed above, one of skill will recognize the appropriate promoter to use to modulate floral development of the plant. Exemplary promoters for this embodiment include constitutive promoters, inducible promoters, shoot-preferred promoters, and inflorescence-preferred promoters.

In other methods, floral development is modulated by altering the level and/or activity of the NUE sequence of the invention. Such methods can comprise introducing a NUE nucleotide sequence into the plant and changing the activity of the NUE polypeptide. In other methods, the NUE nucleotide construct introduced into the plant is stably incorporated into the genome of the plant. Altering expression of the NUE sequence of the invention can modulate floral development during periods of stress. Such methods are described elsewhere herein. Accordingly, the present invention further provides plants having modulated floral development when compared to the floral development of a control plant. Compositions include plants having a altered level/activity of the NUE polypeptide of the invention and having an altered floral development. Compositions also include plants having a modified level/activity of the NUE polypeptide of the invention wherein the plant maintains or proceeds through the flowering process in times of stress.

Methods are also provided for the use of the NUE sequences of the invention to increase seed size and/or weight. The method comprises increasing the activity of the NUE sequences in a plant or plant part, such as the seed. An increase in seed size and/or weight comprises an increased size or weight of the seed and/or an increase in the size or weight of one or more seed part including, for example, the embryo, endosperm, seed coat, aleurone, or cotyledon.

As discussed above, one of skill will recognize the appropriate promoter to use to increase seed size and/or seed weight. Exemplary promoters of this embodiment include constitutive promoters, inducible promoters, seed-preferred promoters, embryo-preferred promoters, and endosperm-preferred promoters.

The method for altering seed size and/or seed weight in a plant comprises increasing NUE activity in the plant. In one embodiment, the NUE nucleotide sequence can be provided by introducing into the plant a polynucleotide comprising a NUE nucleotide sequence of the invention, expressing the NUE sequence, and thereby decreasing seed weight and/or size. In other embodiments, the NUE nucleotide construct introduced into the plant is stably incorporated into the genome of the plant.

It is further recognized that increasing seed size and/or weight can also be accompanied by an increase in the speed of growth of seedlings or an increase in early vigor. As used herein, the term "early vigor" refers to the ability of a plant to grow rapidly during early development, and relates to the successful establishment, after germination, of a well-developed root system and a well-developed photosynthetic apparatus. In addition, an increase in seed size and/or weight can also result in an increase in plant yield when compared to a control.

Accordingly, the present invention further provides plants having an increased seed weight and/or seed size when compared to a control plant. In other embodiments, plants having an increased vigor and plant yield are also provided. In some embodiments, the plant of the invention has a modified level/activity of the NUE polypeptide of the invention and has an increased seed weight and/or seed size. In other embodiments, such plants have stably incorporated into their genome a nucleic acid molecule comprising a NUE nucleotide sequence of the invention operably linked to a promoter that drives expression in the plant cell.

vii. Method of use for NUE Polynucleotide, Expression Cassettes, and Additional Polynucleotides The nucleotides, expression cassettes and methods disclosed herein are useful in regulating expression of any heterologous nucleotide sequence in a host plant in order to vary the phenotype of a plant. Various changes in phenotype are of interest including modifying the fatty acid composition in a plant, altering the amino acid content of a plant, altering a plant's pathogen defense mechanism, and the like. These results can be achieved by providing expression of heterologous products or increased expression of endogenous products in plants. Alternatively, the results can be achieved by providing for a reduction of expression of one or more endogenous products, particularly enzymes or cofactors in the plant. These changes result in a change in phenotype of the transformed plant.

Genes of interest are reflective of the commercial markets and interests of those involved in the development of the crop. Crops and markets of interest change, and as developing nations open up world markets, new crops and technologies will emerge also. In addition, as our understanding of agronomic traits and characteristics such as yield and heterosis increase, the choice of genes for transformation will change accordingly. General categories of genes of interest include, for example, those genes involved in information, such as zinc fingers, those involved in communication, such as kinases, and those involved in housekeeping, such as heat shock proteins. More specific categories of transgenes, for example, include genes encoding important traits for agronomics, insect resistance, disease resistance, herbicide resistance, sterility, grain characteristics, and commercial products. Genes of interest include, generally, those involved in oil, starch, carbohydrate, or nutrient metabolism as well as those affecting kernel size, sucrose loading, and the like.

In certain embodiments the nucleic acid sequences of the present invention can be used in combination ("stacked") with other polynucleotide sequences of interest in order to create plants with a desired phenotype. The combinations generated can include multiple copies of any one or more of the polynucleotides of interest. The polynucleotides of the present invention may be stacked with any gene or combination of genes to produce plants with a variety of desired trait combinations, including but not limited to traits desirable for animal feed such as high oil genes (e.g., U.S. Pat. No. 6,232,529); balanced amino acids (e.g., hordothionins (U.S. Pat. Nos. 5,990,389; 5,885,801; 5,885,802; and 5,703,409); barley high lysine (Williamson, et al., (1987) *Eur. J. Biochem.* 165:99-106; and WO 98/20122); and high methionine proteins (Pedersen, et al., (1986) *J. Biol. Chem.* 261:6279; Kirihara, et al., (1988) *Gene* 71:359; and Musumura, et al., (1989) *Plant Mol. Biol.* 12:123)); increased digestibility (e.g., modified storage proteins (U.S. application Ser. No. 10/053,410, filed Nov. 7, 2001); and thioredoxins (U.S. application Ser. No. 10/005,429, filed Dec. 3, 2001)), the disclosures of which are herein incorporated by reference. The polynucleotides of the present invention can also be stacked with traits desirable for insect, disease or herbicide resistance (e.g., *Bacillus thuringiensis* toxic proteins (U.S. Pat. Nos. 5,366,892; 5,747,450; 5,737,514; 5723,756; 5,593,881; Geiser, et al., (1986) *Gene* 48:109); lectins (Van Damme, et al., (1994) *Plant Mol. Biol.* 24:825); fumonisin detoxification genes (U.S. Pat. No. 5,792,931); avirulence and disease resistance genes (Jones, et al., (1994) *Science* 266:789; Martin, et al., (1993) *Science* 262:1432; Mindrinos, et al., (1994) *Cell* 78:1089); acetolactate synthase (ALS) mutants that lead to herbicide resistance such as the S4 and/or Hra mutations; inhibitors of glutamine synthase such as phosphinothricin or basta (e.g., bar gene); and glyphosate resistance (EPSPS gene)); and traits desirable for processing or process products such as high oil (e.g., U.S. Pat. No. 6,232,529 ); modified oils (e.g., fatty acid desaturase genes (U.S. Pat. No. 5,952,544; WO 94/11516)); modified starches (e.g., ADPG pyrophosphorylases (AGPase), starch synthases (SS), starch branching enzymes (SBE) and starch debranching enzymes (SDBE)); and polymers or bioplastics (e.g., U.S. Pat. No. 5.602,321; beta-ketothiolase, polyhydroxybutyrate synthase, and acetoacetyl-CoA reductase (Schubert, et al., (1988) *J. Bacteriol.* 170:5837-5847) facilitate expression of polyhydroxyalkanoates (PHAs)), the disclosures of which are herein incorporated by reference. One could also combine the polynucleotides of the present invention with polynucleotides affecting agronomic traits such as male sterility (e.g., see U.S. Pat. No. 5.583,210), stalk strength, flowering time, or transformation technology traits such as cell cycle regulation or gene targeting (e.g., WO 99/61619; WO 00/17364; WO 99/25821), the disclosures of which are herein incorporated by reference.

In one embodiment, sequences of interest improve plant growth and/or crop yields. For example, sequences of interest include agronomically important genes that result in improved primary or lateral root systems. Such genes include, but are not limited to, nutrient/water transporters and growth induces. Examples of such genes, include but are not limited to, maize plasma membrane $H^+$-ATPase (MHA2) (Frias, et al., (1996) *Plant Cell* 8:1533-44); AKT1, a component of the potassium uptake apparatus in *Arabidopsis*, (Spalding, et al., (1999) *J Gen Physiol* 113:909-18); RML genes which activate cell division cycle in the root apical cells (Cheng, et al., (1995) *Plant Physiol* 108:881); maize glutamine synthetase genes (Sukanya, et al., (1994) *Plant Mol Biol* 26:1935-46) and hemoglobin (Duff, et al., (1997) *J. Biol. Chem* 27:16749-16752, Arredondo-Peter, et al., (1997) *Plant Physiol.* 115: 1259-1266; Arredondo-Peter, et al., (1997) *Plant Physiol* 114:493-500 and references sited therein). The sequence of interest may also be useful in expressing antisense nucleotide sequences of genes that that negatively affects root development.

Additional, agronomically important traits such as oil, starch, and protein content can be genetically altered in addition to using traditional breeding methods. Modifications include increasing content of oleic acid, saturated and unsaturated oils, increasing levels of lysine and sulfur, providing essential amino acids, and also modification of starch. Hordothionin protein modifications are described in U.S. Pat. Nos. 5,703,049, 5,885,801, 5,885,802, and 5,990,389, herein incorporated by reference. Another example is lysine and/or sulfur rich seed protein encoded by the soybean 2S albumin described in U.S. Pat. No. 5,850,016, and the chymotrypsin inhibitor from barley, described in Williamson, et al., (1987) *Eur. J. Biochem.* 165:99-106, the disclosures of which are herein incorporated by reference.

Derivatives of the coding sequences can be made by site-directed mutagenesis to increase the level of preselected amino acids in the encoded polypeptide. For example, the gene encoding the barley high lysine polypeptide (BHL) is derived from barley chymotrypsin inhibitor, U.S. application Ser. No. 08/740,682, filed Nov. 1, 1996, and WO 98/20133, the disclosures of which are herein incorporated by reference. Other proteins include methionine-rich plant proteins such as from sunflower seed (Lilley, et al., (1989) *Proceedings of the World Congress on Vegetable Protein Utilization in Human Foods and Animal Feedstuffs*, ed. Applewhite (American Oil Chemists Society, Champaign, Ill.), pp. 497-502; herein incorporated by reference); corn (Pedersen, et al., (1986) *J. Biol. Chem.* 261:6279; Kirihara, et al., (1988) *Gene* 71:359; both of which are herein incorporated by reference); and rice (Musumura, et al., (1989) *Plant Mol. Biol.* 12:123, herein incorporated by reference). Other agronomically important genes encode latex, Floury 2, growth factors, seed storage factors, and transcription factors.

Insect resistance genes may encode resistance to pests that have great yield drag such as rootworm, cutworm, European Corn Borer, and the like. Such genes include, for example, *Bacillus thuringiensis* toxic protein genes (U.S. Pat. Nos. 5,366,892; 5,747,450; 5,736,514; 5,723,756; 5,593,881; and Geiser, et al., (1986) *Gene* 48:109); and the like.

Genes encoding disease resistance traits include detoxification genes, such as against fumonosin (U.S. Pat. No. 5,792, 931); avirulence (avr) and disease resistance (R) genes (Jones, et al., (1994) *Science* 266:789; Martin, et al., (1993) *Science* 262:1432; and Mindrinos, etal., (1994) *Cell* 78:1089); and the like.

Herbicide resistance traits may include genes coding for resistance to herbicides that act to inhibit the action of acetolactate synthase (ALS), in particular the sulfonylurea-type herbicides (e.g., the acetolactate synthase (ALS) gene containing mutations leading to such resistance, in particular the S4 and/or Hra mutations), genes coding for resistance to herbicides that act to inhibit action of glutamine synthase, such as phosphinothricin or basta (e.g., the bar gene), or other such genes known in the art. The bar gene encodes resistance to the herbicide basta, the nptII gene encodes resistance to the antibiotics kanamycin and geneticin, and the ALS-gene mutants encode resistance to the herbicide chlorsulfuron.

Sterility genes can also be encoded in an expression cassette and provide an alternative to physical detasseling. Examples of genes used in such ways include male tissue-preferred genes and genes with male sterility phenotypes such as QM, described in U.S. Pat. No. 5,583,210. Other genes include kinases and those encoding compounds toxic to either male or female gametophytic development.

The quality of grain is reflected in traits such as levels and types of oils, saturated and unsaturated, quality and quantity of essential amino acids, and levels of cellulose. In corn, modified hordothionin proteins are described in U.S. Pat. Nos. 5,703,049, 5,885,801, 5,885,802, and 5,990,389.

Commercial traits can also be encoded on a gene or genes that could increase for example, starch for ethanol production, or provide expression of proteins. Another important commercial use of transformed plants is the production of polymers and bioplastics such as described in U.S. Pat. No. 5,602,321. Genes such as β-Ketothiolase, PHBase (polyhydroxyburyrate synthase), and acetoacetyl-CoA reductase (see, Schubert, et al., (1988) *J. Bacteriol.* 170:5837-5847) facilitate expression of polyhyroxyalkanoates (PHAs).

Exogenous products include plant enzymes and products as well as those from other sources including procaryotes and other eukaryotes. Such products include enzymes, cofactors, hormones, and the like. The level of proteins, particularly modified proteins having improved amino acid distribution to improve the nutrient value of the plant, can be increased. This is achieved by the expression of such proteins having enhanced amino acid content.

This invention can be better understood by reference to the following non-limiting examples. It will be appreciated by those skilled in the art that other embodiments of the invention may be practiced without departing from the spirit and the scope of the invention as herein disclosed and claimed.

EXAMPLES

Example 1

Isolation of NUE Sequences

A routine for identifying all members of a gene family can be employed to search for the enhanced nitrogen utilization efficiency genes of interest. A diverse set of all the known members of the gene family as protein sequences would be prepared. This data includes sequences from other species. These species are then searched against a proprietary maize sequence dataset and a nonredundant set of overlapping hits is identified. Separately, one takes the nucleotide sequences of any genes of interest in hand and searches against the database and a nonredundant set of all overlapping hits are retrieved. The set of protein hits are then compared to the nucleotide hits. If the gene family is complete, all of the protein hits are contained within the nucleotide hits.

Example 2

Categorization of NUE by Function

TABLE 1

| Gene Description | Functional Grouping | SEQ ID NOS: NA/AA |
|---|---|---|
| Zinc finger transcription factor | Transcription Factor | 1/2 |
| MADS-domain transcription factor | Transcription Factor | 3/4 |
| Myb-related transcription factor | Transcription Factor | 5/6 |
| MADS-domain transcription factor | Transcription Factor | 7/8 |
| Protein kinase | Signal Transduction | 9/10 |
| Nitric Oxidase Synthase | Signal Transduction | 11/12 |
| Ferredoxin-NADP+ reductase | Nitrogen-Carbon Assimilation | 13/14 |
| Ferredoxin-nitrate reductase | Nitrogen-Carbon Assimilation | 15/16 |
| B-type cyclin | Miscellaneous or unknown function | 17/18 |
| RING-H2 finger protein | Signal Transduction | 19/20 |
| Ferredoxin-nitrate reductase | Nitrogen-Carbon Assimilation | 21/22 |
| Glycine decarboxylase complex H-protein | Amino acid metabolism | 23/24 |
| Unknown or Hypothetical (Conserved) Protein | Miscellaneous or unknown function | 25/26 |
| Transketolase | Metabolic Enzyme | 27/28 |
| Ferredoxin | Nitrogen-Carbon Assimilation | 29/30 |
| Hydrolase | Metabolic Enzyme | 31/32 |
| Unknown or Hypothetical (Conserved) Protein | Miscellaneous or unknown function | 33/34 |
| Serine/threonine kinase | Signal Transduction | 35/36 |
| Unknown or Hypothetical (Conserved) Protein | Miscellaneous or unknown function | 37/38 |
| Vacuolar H+-exporting ATPase | Transporter | 39/40 |
| Unknown or Hypothetical (Conserved) Protein | Miscellaneous or unknown function | 41/42 |
| Putative monodehydroascorbate reductase | Stress and Hormone Response | 43/44 |
| Homeodomain leucine zipper protein | Transcription Factor | 45/46 |
| 3-isopropylmalate dehydratase large subunit | Metabolic Enzyme | 47/48 |
| Unknown or Hypothetical (Conserved) Protein | Miscellaneous or unknown function | 49/50 |
| Polyamine oxidase | Stress and Hormone Response | 51/52 |
| Unknown or Hypothetical (Conserved) Protein | Miscellaneous or unknown function | 53/54 |
| Arginine N-methyltransferase | Amino acid metabolism | 55/56 |
| Putative succinyl-CoA ligase alpha subunit | Metabolic Enzyme | 57/58 |
| Asparagine synthasetase | Amino acid metabolism | 59/60 |
| Ferredoxin | Nitrogen-Carbon Assimilation | 61/62 |
| tRNA synthetase class II (G, H, P and S) family protein | Metabolic Enzyme | 63/64 |
| Putative HB2 homeodomain protein | Transcription Factor | 65/66 |
| EREBP-like protein | Transcription Factor | 67/68 |
| Aspartate carbamoyl transferase | Amino acid metabolism | 69/70 |
| Putative amino acid transport | Transporter | 71/72 |
| N-carbamyl-L-amino acid amidohydrolase | Amino acid metabolism | 73/74 |
| Mitochondrial malate dehydrogenase | Metabolic Enzyme | 75/76 |
| Adenosylhomocysteinase-like protein | Metabolic Enzyme | 77/78 |
| Endonuclease/exonuclease/phosphatase family protein-like | Metabolic Enzyme | 79/80 |
| Rapamycin-binding protein | Miscellaneous or unknown function | 81/82 |
| Putative leucine-rich receptor-like protein kinase | Signal Transduction | 83/84 |
| Unknown or Hypothetical (Conserved) Protein | Miscellaneous or unknown function | 85/86 |
| Unknown or Hypothetical (Conserved) Protein | Miscellaneous or unknown function | 87/88 |
| Pathogenesis related protein | Stress and Hormone Response | 89/90 |
| Peptide transport protein | Transporter | 91/92 |
| Ferredoxin | Nitrogen-Carbon Assimilation | 93/94 |
| Aminoacylase | Amino acid metabolism | 95/96 |
| PDR-type ABC transporter-like | Transporter | 97/98 |
| Unknown or Hypothetical (Conserved) Protein | Miscellaneous or unknown function | 99/100 |
| DRE binding factor 2 | Miscellaneous or unknown function | 101/102 |
| Glycine hydroxymethyltransferase | Amino acid metabolism | 103/104 |
| Dentin sialophosphoprotein precursor-like protein | Miscellaneous or unknown function | 105/106 |
| ATP-citrate synthase | Metabolic Enzyme | 107/108 |
| Gamma-lyase | Metabolic Enzyme | 109/110 |
| Unknown or Hypothetical (Conserved) Protein | Miscellaneous or unknown function | 111/112 |
| Unknown or Hypothetical (Conserved) Protein | Miscellaneous or unknown function | 113/114 |
| Unknown or Hypothetical (Conserved) Protein | Miscellaneous or unknown function | 115/116 |
| Unknown or Hypothetical (Conserved) Protein | Miscellaneous or unknown function | 117/118 |
| Unknown or Hypothetical (Conserved) Protein | Miscellaneous or unknown function | 119/120 |
| Histidine amino acid transporter | Transporter | 121/122 |
| NOD26-like membrane integral protein ZmNIP2-2 | Transporter | 123/124 |
| Glucose-6-phosphate/phosphate-translocator precursor | Transporter | 125/126 |
| Lipoxygenase | Stress and Hormone Response | 127/128 |
| Homocysteine S-methyltransferase | Stress and Hormone Response | 129/130 |
| Ferredoxin | Nitrogen-Carbon Assimilation | 131/132 |
| Ferredoxin-dependent glutamate synthase, chloroplast | Nitrogen-Carbon Assimilation | 133/134 |
| Glutamine synthase | Nitrogen-Carbon Assimilation | 135/136 |
| Glutamine synthase | Nitrogen-Carbon Assimilation | 137/138 |
| Cytoskeletal protein | Miscellaneous or unknown function | 139/140 |

TABLE 1-continued

| Gene Description | Functional Grouping | SEQ ID NOS: NA/AA |
|---|---|---|
| OCL3 protein | Miscellaneous or unknown function | 141/142 |
| Seven in absentia | Miscellaneous or unknown function | 143/144 |
| Copper chaperone | Miscellaneous or unknown function | 145/146 |
| Branched-chain amino acid aminotransferase | Amino acid metabolism | 147/148 |
| Glutamate dehydrogenase | Amino acid metabolism | 149/150 |
| Hydroxyanthranilate hydroxycinnamoyltransferase | Amino acid metabolism | 151/152 |
| Alanine aminotransferase | Amino acid metabolism | 153/154 |
| Tryptophan synthase | Amino acid metabolism | 155/156 |
| Putative aspartate aminotransferase | Amino acid metabolism | 157/158 |
| Uroporphyrin-III C-methyltransferase | Metabolic Enzyme | 159/160 |
| Unknown or Hypothetical (Conserved) Protein | Miscellaneous or unknown function | 161/162 |
| ATP-dependent transporter | Transporter | 163/164 |
| Permease | Transporter | 165/166 |
| ABA-responsive protein | Stress and Hormone Response | 167/168 |
| GTPase activating protein-like | Stress and Hormone Response | 169/170 |
| Lypoxygenase | Stress and Hormone Response | 171/172 |
| Ferredoxin | Nitrogen-Carbon Assimilation | 173/174 |
| Fd III | Nitrogen-Carbon Assimilation | 175/176 |
| Nitrate reductase | Nitrogen-Carbon Assimilation | 177/178 |
| NADP-specific isocitrate dehydrogenase | Miscellaneous or unknown function | 179/180 |
| Nucleic acid binding protein | Miscellaneous or unknown function | 181/182 |
| Arginine N-methyltransferase | Amino acid metabolism | 183/184 |
| Lysine decarboxylase-like protein | Amino acid metabolism | 185/186 |
| Glutamate decarboxylase isozyme | Amino acid metabolism | 187/188 |
| Arginine decarboxylase (ADC) | Amino acid metabolism | 189/190 |
| Arginine decarboxylase (ADC) | Amino acid metabolism | 191/192 |
| MATE efflux family protein | Transporter | 193/194 |
| Putative nitrate transporter | Transporter | 195/196 |
| Oligopeptide transporter OPT-like | Transporter | 197/198 |
| Ammonium transporter | Transporter | 199/200 |
| Amino acid transport protein AAP1 | Transporter | 201/202 |
| Putative oligopeptide transporter | Transporter | 203/204 |
| NAC Transcription factor | Transcription Factor | 205/206 |
| Myb transcription factor | Transcription Factor | 207/208 |
| MADS-domain transcription factor | Transcription Factor | 209/210 |
| Abscisic acid- and stress-inducible protein | Stress and Hormone Response | 211/212 |
| Trehalose-6-phosphate synthase | Stress and Hormone Response | 213/214 |
| F-box protein; coronatine-insensitive 1/COL1 (FBL2) | Signal Transduction | 215/216 |
| Alanine aminotransferase | Amino acid metabolism | 217/218 |
| Putative sulfate transporter | Transporter | 219/220 |
| Nitrate transporter, putative | Transporter | 221/222 |
| Ethylene-responsive element binding factor | Transcription Factor | 223/224 |
| Unknown; WRKY transcription factor? | Miscellaneous or unknown function | 225/226 |
| Ethylene-responsive element binding factor | Transduction Factor | 227/228 |
| Ser-Thr Protein Kinase | Signal Transduction | 229/230 |
| Leucine-rich repeat family protein/protein kinase family protein | Signal Transduction | 231/232 |
| Putative IAA-amino acid hydrolase | Stress and Hormone Response | 233/234 |
| Carbon-nitrogen hydrolase family protein | Nitrogen-Carbon Assimilation | 235/236 |
| Glutamine synthase | Nitrogen-Carbon Assimilation | 237/238 |
| Glutamine synthase | Nitrogen-Carbon Assimilation | 239/240 |
| Drought-induced hydrophobic protein | Stress and Hormone Response | 241/242 |
| Amino acid transporter | Transporter | 243/244 |
| Diacylglycerol kinase | Metabolic Enzyme | 245/246 |
| Nitrite reductase | Nitrogen-Carbon Assimilation | 247/248 |
| Putative potassium transporter | Transporter | 249/250 |
| Putative sugar transporter | Transporter | 251/252 |
| S-adenosylmethionine decarboxylase | Stress and Hormone Response | 253/254 |
| TA1 protein-like | Miscellaneous or unknown function | 255/256 |
| Unknown or Hypothetical (Conserved) Protein | Miscellaneous or unknown function | 257/258 |
| glutamate decarboxylase | Amino acid metabolism | 259/260 |
| Aminotransferase | Amino acid metabolism | 261/262 |
| Alanine aminotransferase | Amino acid metabolism | 263/264 |
| Diphthamide synthesis DPH2-like | Miscellaneous or unknown function | 265/266 |
| Unknown or Hypothetical (Conserved) Protein | Miscellaneous or unknown function | 267/268 |
| Unknown or Hypothetical (Conserved) Protein | Miscellaneous or unknown function | 269/270 |
| Unknown or Hypothetical (Conserved) Protein | Miscellaneous or unknown function | 271/272 |
| Hydrolase | Metabolic Enzyme | 273/274 |
| Alliinase | Miscellaneous or unknown function | 275/276 |
| Molybdenum cofactor synthesis protein 3 | Nitrogen-Carbon Assimilation | 277/278 |
| Unknown or Hypothetical (Conserved) Protein | Miscellaneous or unknown function | 279/280 |
| Unknown or Hypothetical (Conserved) Protein | Miscellaneous or unknown function | 281/282 |
| Acylaminoacyl-peptidase | Metabolic Enzyme | 283/284 |
| Serine palmitoyltransferase | Amino acid metabolism | 285/286 |
| Unknown or Hypothetical (Conserved) Protein | Miscellaneous or unknown function | 287/288 |
| Unknown or Hypothetical (Conserved) Protein | Miscellaneous or unknown function | 289/290 |
| Permease | Transporter | 291/292 |

TABLE 1-continued

| Gene Description | Functional Grouping | SEQ ID NOS: NA/AA |
|---|---|---|
| Amino acid permease | Transporter | 293/294 |
| Putative early nodulin | Miscellaneous or unknown function | 295/296 |
| Nitrilase 1 | Miscellaneous or unknown function | 297/298 |
| Putative 3-isopropylmalate dehydrogenase | Metabolic Enzyme | 299/300 |
| Glutamine synthetase | Nitrogen-Carbon Assimilation | 301/302 |
| S-adenosylmethionine decarboxylase | Stress and Hormone Response | 303/304 |
| ABSCISIC STRESS RIPENING PROTEIN 3 | Stress and Hormone Response | 305/306 |
| Uroporphyrin-III C-methyltransferase | Miscellaneous or unknown function | 307/308 |
| Metallopeptidase | Metabolic Enzyme | 309/310 |
| Prolyl aminopeptidase | Amino acid metabolism | 311/312 |
| Root-specific metal transporter | Transporter | 313/314 |

Example 3

Expression Patterns in Maize using MPSS

MPSS stands for Massively Parallel Signature Sequencing, a technique invented and commercialized by Lynx Therapeutics, Inc. of Hayward, Calif. MPSS and related technologies have been described in publications by Brenner, et al., (*Nature Biotechnol.* (2000) 18:630-634, and *PNAS* (2000) 97:1665-1670). Like SAGE (Serial Analysis of Gene Expression), MPSS produces short sequence signatures produced from a defined position within an mRNA, and the relative abundance of these signatures in a given library represents a quantitative estimate of expression of that gene. The MPSS signatures are 17 bp in length, and can uniquely identify >95% of all genes in Arabidopsis.

The NUE sequences were matched to MPSS data, and matching tags (GATC-17mers) were curated. Ideally, the correct tag for a gene is in the plus strand proximal to but just up from the poly A tail, and it is gene specific. Where more than one tag matches a gene, one will usually choose the one closest to the poly A tail, which is also usually the one with the highest gene expression. Where the tag matches more than one gene, the correct gene association is usually the one that has an EST distribution that best corresponds to the expression pattern revealed by the MPSS data.

Example 4

Transformation and Regeneration of Transgenic Plants

Immature maize embryos from greenhouse donor plants are bombarded with a plasmid containing the NUE sequence operably linked to the drought-inducible promoter RAB17 promoter (Vilardell, et al., (1990) *Plant Mol Biol* 14:423-432) and the selectable marker gene PAT, which confers resistance to the herbicide Bialaphos. Alternatively, the selectable marker gene is provided on a separate plasmid. Transformation is performed as follows. Media recipes follow below.

Preparation of Target Tissue:

The ears are husked and surface sterilized in 30% Clorox bleach plus 0.5% Micro detergent for 20 minutes, and rinsed two times with sterile water. The immature embryos are excised and placed embryo axis side down (scutellum side up), 25 embryos per plate, on 560 Y medium for 4 hours and then aligned within the 2.5-cm target zone in preparation for bombardment.

Preparation of DNA:

A plasmid vector comprising the NUE sequence operably linked to an ubiquitin promoter is made. This plasmid DNA plus plasmid DNA containing a PAT selectable marker is precipitated onto 1.1 μm (average diameter) tungsten pellets using a $CaCl_2$ precipitation procedure as follows:

100 μl prepared tungsten particles in water
10 μl (1 μg) DNA in Tris EDTA buffer (1 μg total DNA)
100 μl 2.5 M $CaCl_2$
10 μl 0.1 M spermidine Each reagent is added sequentially to the tungsten particle suspension, while maintained on the multitube vortexer. The final mixture is sonicated briefly and allowed to incubate under constant vortexing for 10 minutes. After the precipitation period, the tubes are centrifuged briefly, liquid removed, washed with 500 ml 100% ethanol, and centrifuged for 30 seconds. Again the liquid is removed, and 105 μl 100% ethanol is added to the final tungsten particle pellet. For particle gun bombardment, the tungsten/DNA particles are briefly sonicated and 10 μl spotted onto the center of each macrocarrier and allowed to dry about 2 minutes before bombardment.

Particle Gun Treatment:

The sample plates are bombarded at level #4 in a particle gun. All samples receive a single shot at 650 PSI, with a total of ten aliquots taken from each tube of prepared particles/DNA.

Subsequent Treatment:

Following bombardment, the embryos are kept on 560 Y medium for 2 days, then transferred to 560 R selection medium containing 3 mg/liter Bialaphos, and subcultured every 2 weeks. After approximately 10 weeks of selection, selection-resistant callus clones are transferred to 288 J medium to initiate plant regeneration. Following somatic embryo maturation (2-4 weeks), well-developed somatic embryos are transferred to medium for germination and transferred to the lighted culture room. Approximately 7-10 days later, developing plantlets are transferred to 272 V hormone-free medium in tubes for 7-10 days until plantlets are well established. Plants are then transferred to inserts in flats (equivalent to 2.5" pot) containing potting soil and grown for 1 week in a growth chamber, subsequently grown an additional 1-2 weeks in the greenhouse, then transferred to classic 600 pots (1.6 gallon) and grown to maturity. Plants are monitored and scored for increased drought tolerance. Assays to measure improved drought tolerance are routine in the art and include, for example, increased kernel-earring capacity yields under drought conditions when compared to control maize plants under identical environmental conditions. Alternatively, the transformed plants can be monitored for a modulation in meristem development (i.e., a decrease in spikelet formation on the ear). See, for example, Bruce, et al., (2002) *Journal of Experimental Botany* 53:1-13.

Bombardment and Culture Media:

Bombardment medium (560Y) comprises 4.0 g/l N6 basal salts (SIGMA C-1416), 1.0 ml/l Eriksson's Vitamin Mix (1000× SIGMA-1511), 0.5 mg/l thiamine HCl, 120.0 g/l sucrose, 1.0 mg/l 2,4-D, and 2.88 g/l L-proline (brought to volume with D-I $H_2O$ following adjustment to pH 5.8 with KOH); 2.0 g/l Gelrite (added after bringing to volume with D-I $H_2O$); and 8.5 mg/l silver nitrate (added after sterilizing the medium and cooling to room temperature). Selection medium (560 R) comprises 4.0 g/l N6 basal salts (SIGMA C-1416), 1.0 ml/l Eriksson's Vitamin Mix (1000× SIGMA-1511), 0.5 mg/l thiamine HCl, 30.0 g/l sucrose, and 2.0 mg/l 2,4-D (brought to volume with D-I $H_2O$ following adjustment to pH 5.8 with KOH); 3.0 g/l Gelrite (added after bringing to volume with D-I $H_2O$); and 0.85 mg/l silver nitrate and 3.0 mg/l bialaphos (both added after sterilizing the medium and cooling to room temperature).

Plant regeneration medium (288 J) comprises 4.3 g/l MS salts (GIBCO 11117-074), 5.0 ml/l MS vitamins stock solution (0.100 g nicotinic acid, 0.02 g/l thiamine HCL, 0.10 g/l pyridoxine HCL, and 0.40 g/l glycine brought to volume with polished D-I $H_2O$) (Murashige and Skoog, (1962) *Physiol. Plant.* 15:473), 100 mg/l myo-inositol, 0.5 mg/l zeatin, 60 g/l sucrose, and 1.0 ml/l of 0.1 mM abscisic acid (brought to volume with polished D-I $H_2O$ after adjusting to pH 5.6); 3.0 g/l Gelrite (added after bringing to volume with D-I $H_2O$); and 1.0 mg/l indoleacetic acid and 3.0 mg/l bialaphos (added after sterilizing the medium and cooling to 60° C.). Hormone-free medium (272 V) comprises 4.3 g/l MS salts (GIBCO 11117-074), 5.0 ml/l MS vitamins stock solution (0.100 g/l nicotinic acid, 0.02 g/l thiamine HCL, 0.10 g/l pyridoxine HCL, and 0.40 g/l glycine brought to volume with polished D-I $H_2O$), 0.1 g/l myo-inositol, and 40.0 g/l sucrose (brought to volume with polished D-I $H_2O$ after adjusting pH to 5.6); and 6 g/l bacto-agar (added after bringing to volume with polished D-I $H_2O$), sterilized and cooled to 60° C.

Example 5

*Agrobacterium*-mediated Transformation

For *Agrobacterium*-mediated transformation of maize with an antisense sequence of the NUE sequence of the present invention, preferably the method of Zhao is employed (U.S. Pat. No. 5,981,840, and PCT patent publication WO98/32326; the contents of which are hereby incorporated by reference). Briefly, immature embryos are isolated from maize and the embryos contacted with a suspension of *Agrobacterium*, where the bacteria are capable of transferring the antisense NUE sequences to at least one cell of at least one of the immature embryos (step 1: the infection step). In this step the immature embryos are preferably immersed in an *Agrobacterium* suspension for the initiation of inoculation. The embryos are co-cultured for a time with the *Agrobacterium* (step 2: the co-cultivation step). Preferably the immature embryos are cultured on solid medium following the infection step. Following this co-cultivation period an optional "resting" step is contemplated. In this resting step, the embryos are incubated in the presence of at least one antibiotic known to inhibit the growth of *Agrobacterium* without the addition of a selective agent for plant transformants (step 3: resting step). Preferably the immature embryos are cultured on solid medium with antibiotic, but without a selecting agent, for elimination of *Agrobacterium* and for a resting phase for the infected cells. Next, inoculated embryos are cultured on medium containing a selective agent and growing transformed callus is recovered (step 4: the selection step). Preferably, the immature embryos are cultured on solid medium with a selective agent resulting in the selective growth of transformed cells. The callus is then regenerated into plants (step 5: the regeneration step), and preferably calli grown on selective medium are cultured on solid medium to regenerate the plants. Plants are monitored and scored for a modulation in meristem development. For instance, alterations of size and appearance of the shoot and floral meristems and/or increased yields of leaves, flowers, and/or fruits.

Example 6

Soybean Embryo Transformation

Soybean embryos are bombarded with a plasmid containing an antisense NUE sequences operably linked to an ubiquitin promoter as follows. To induce somatic embryos, cotyledons, 3-5 mm in length dissected from surface-sterilized, immature seeds of the soybean cultivar A2872, are cultured in the light or dark at 26° C. on an appropriate agar medium for six to ten weeks. Somatic embryos producing secondary embryos are then excised and placed into a suitable liquid medium. After repeated selection for clusters of somatic embryos that multiplied as early, globular-staged embryos, the suspensions are maintained as described below.

Soybean embryogenic suspension cultures can be maintained in 35 ml liquid media on a rotary shaker, 150 rpm, at 26° C. with florescent lights on a 16:8 hour day/night schedule. Cultures are subcultured every two weeks by inoculating approximately 35 mg of tissue into 35 ml of liquid medium.

Soybean embryogenic suspension cultures may then be transformed by the method of particle gun bombardment (Klein, et al., (1987) *Nature* (London) 327:70-73, U.S. Pat. No. 4,945,050). A Du Pont Biolistic PDS1000/HE instrument (helium retrofit) can be used for these transformations.

A selectable marker gene that can be used to facilitate soybean transformation is a transgene composed of the 35S promoter from Cauliflower Mosaic Virus (Odell, et al., (1985) *Nature* 313:810-812), the hygromycin phosphotransferase gene from plasmid pJR225 (from *E. coli*; Gritz, et al., (1983) *Gene* 25:179-188), and the 3' region of the nopaline synthase gene from the T-DNA of the Ti plasmid of *Agrobacterium tumefaciens*. The expression cassette comprising an antisense NUE sequence operably linked to the ubiquitin promoter can be isolated as a restriction fragment. This fragment can then be inserted into a unique restriction site of the vector carrying the marker gene.

To 50 µl of a 60 mg/ml 1 µm gold particle suspension is added (in order): 5 µl DNA (1 µg/µl), 20 µl spermidine (0.1 M), and 50 µl $CaCl_2$ (2.5 M). The particle preparation is then agitated for three minutes, spun in a microfuge for 10 seconds and the supernatant removed. The DNA-coated particles are then washed once in 400 µl 70% ethanol and resuspended in 40 µl of anhydrous ethanol. The DNA/particle suspension can be sonicated three times for one second each. Five microliters of the DNA-coated gold particles are then loaded on each macro carrier disk.

Approximately 300-400 mg of a two-week-old suspension culture is placed in an empty 60×15 mm petri dish and the residual liquid removed from the tissue with a pipette. For each transformation experiment, approximately 5-10 plates of tissue are normally bombarded. Membrane rupture pressure is set at 1100 psi, and the chamber is evacuated to a vacuum of 28 inches mercury. The tissue is placed approximately 3.5 inches away from the retaining screen and bombarded three times. Following bombardment, the tissue can be divided in half and placed back into liquid and cultured as described above.

Five to seven days post bombardment, the liquid media may be exchanged with fresh media, and eleven to twelve days post-bombardment with fresh media containing 50 mg/ml hygromycin. This selective media can be refreshed weekly. Seven to eight weeks post-bombardment, green, transformed tissue may be observed growing from untransformed, necrotic embryogenic clusters. Isolated green tissue is removed and inoculated into individual flasks to generate new, clonally propagated, transformed embryogenic suspension cultures. Each new line may be treated as an independent transformation event. These suspensions can then be subcultured and maintained as clusters of immature embryos or regenerated into whole plants by maturation and germination of individual somatic embryos.

Example 7

Sunflower Meristem Tissue Transformation

Sunflower meristem tissues are transformed with an expression cassette containing an antisense NUE sequences operably linked to a ubiquitin promoter as follows (see also, European Patent Number EP 0 486233, herein incorporated by reference, and Malone-Schoneberg, et al., (1994) *Plant Science* 103:199-207). Mature sunflower seed (*Helianthus annuus* L.) are dehulled using a single wheat-head thresher. Seeds are surface sterilized for 30 minutes in a 20% Clorox bleach solution with the addition of two drops of Tween 20 per 50 ml of solution. The seeds are rinsed twice with sterile distilled water.

Split embryonic axis explants are prepared by a modification of procedures described by Schrammeijer, et al. (Schrammeijer, et al., (1990) *Plant Cell Rep.* 9:55-60). Seeds are imbibed in distilled water for 60 minutes following the surface sterilization procedure. The cotyledons of each seed are then broken off, producing a clean fracture at the plane of the embryonic axis. Following excision of the root tip, the explants are bisected longitudinally between the primordial leaves. The two halves are placed, cut surface up, on GBA medium consisting of Murashige and Skoog mineral elements (Murashige, et al., (1962) *Physiol. Plant.*, 15:473-497), Shepard's vitamin additions (Shepard, (1980) in *Emergent Techniques for the Genetic Improvement of Crops* (University of Minnesota Press, St. Paul, Minn.), 40 mg/l adenine sulfate, 30 g/l sucrose, 0.5 mg/l 6-benzyl-aminopurine (BAP), 0.25 mg/l indole-3-acetic acid (IAA), 0.1 mg/l gibberellic acid ($GA_3$), pH 5.6, and 8 g/l Phytagar.

The explants are subjected to microprojectile bombardment prior to *Agrobacterium* treatment (Bidney, et al., (1992) *Plant Mol. Biol.* 18:301-313). Thirty to forty explants are placed in a circle at the center of a 60×20 mm plate for this treatment. Approximately 4.7 mg of 1.8 mm tungsten microprojectiles are resuspended in 25 ml of sterile TE buffer (10 mM Tris HCl, 1 mM EDTA, pH 8.0) and 1.5 ml aliquots are used per bombardment. Each plate is bombarded twice through a 150 mm nytex screen placed 2 cm above the samples in a PDS 1000® particle acceleration device.

Disarmed *Agrobacterium tumefaciens* strain EHA105 is used in all transformation experiments. A binary plasmid vector comprising the expression cassette that contains the NUE gene operably linked to the ubiquitin promoter is introduced into *Agrobacterium* strain EHA105 via freeze-thawing as described by Holsters, et al., (1978) *Mol. Gen. Genet.* 163:181-187. This plasmid further comprises a kanamycin selectable marker gene (i.e, nptII). Bacteria for plant transformation experiments are grown overnight (28° C. and 100 RPM continuous agitation) in liquid YEP medium (10 gm/l yeast extract, 10 gm/l Bactopeptone, and 5 gm/l NaCl, pH 7.0) with the appropriate antibiotics required for bacterial strain and binary plasmid maintenance. The suspension is used when it reaches an $OD_{600}$ of about 0.4 to 0.8. The *Agrobacterium* cells are pelleted and resuspended at a final $OD_{600}$ of 0.5 in an inoculation medium comprised of 12.5 mM MES pH 5.7, 1 gm/l $NH_4Cl$, and 0.3 gm/l $MgSO_4$.

Freshly bombarded explants are placed in an *Agrobacterium* suspension, mixed, and left undisturbed for 30 minutes. The explants are then transferred to GBA medium and co-cultivated, cut surface down, at 26° C. and 18-hour days. After three days of co-cultivation, the explants are transferred to 374B (GBA medium lacking growth regulators and a reduced sucrose level of 1%) supplemented with 250 mg/l cefotaxime and 50 mg/l kanamycin sulfate. The explants are cultured for two to five weeks on selection and then transferred to fresh 374B medium lacking kanamycin for one to two weeks of continued development. Explants with differentiating, antibiotic-resistant areas of growth that have not produced shoots suitable for excision are transferred to GBA medium containing 250 mg/l cefotaxime for a second 3-day phytohormone treatment. Leaf samples from green, kanamycin-resistant shoots are assayed for the presence of NPTII by ELISA and for the presence of transgene expression by assaying for a modulation in meristem development (i.e., an alteration of size and appearance of shoot and floral meristems).

NPTII-positive shoots are grafted to Pioneer® hybrid 6440 in vitro-grown sunflower seedling rootstock. Surface sterilized seeds are germinated in 48-0 medium (half-strength Murashige and Skoog salts, 0.5% sucrose, 0.3% gelrite, pH 5.6) and grown under conditions described for explant culture. The upper portion of the seedling is removed, a 1 cm vertical slice is made in the hypocotyl, and the transformed shoot inserted into the cut. The entire area is wrapped with parafilm to secure the shoot. Grafted plants can be transferred to soil following one week of in vitro culture. Grafts in soil are maintained under high humidity conditions followed by a slow acclimatization to the greenhouse environment. Transformed sectors of $T_0$ plants (parental generation) maturing in the greenhouse are identified by NPTII ELISA and/or by NUE activity analysis of leaf extracts while transgenic seeds harvested from NPTII-positive $T_0$ plants are identified by NUE activity analysis of small portions of dry seed cotyledon.

An alternative sunflower transformation protocol allows the recovery of transgenic progeny without the use of chemical selection pressure. Seeds are dehulled and surface-sterilized for 20 minutes in a 20% Clorox bleach solution with the addition of two to three drops of Tween 20 per 100 ml of solution, then rinsed three times with distilled water. Sterilized seeds are imbibed in the dark at 26° C. for 20 hours on filter paper moistened with water. The cotyledons and root radical are removed, and the meristem explants are cultured on 374E (GBA medium consisting of MS salts, Shepard vitamins, 40 mg/l adenine sulfate, 3% sucrose, 0.5 mg/l 6-BAP, 0.25 mg/l IAA, 0.1 mg/l GA, and 0.8% Phytagar at pH 5.6) for 24 hours under the dark. The primary leaves are removed to expose the apical meristem, around 40 explants are placed with the apical dome facing upward in a 2 cm circle in the center of 374 M (GBA medium with 1.2% Phytagar), and then cultured on the medium for 24 hours in the dark.

Approximately 18.8 mg of 1.8 μm tungsten particles are resuspended in 150 μl absolute ethanol. After sonication, 8 μl of it is dropped on the center of the surface of macrocarrier.

Each plate is bombarded twice with 650 psi rupture discs in the first shelf at 26 mm of Hg helium gun vacuum.

The plasmid of interest is introduced into *Agrobacterium tumefaciens* strain EHA105 via freeze thawing as described previously. The pellet of overnight-grown bacteria at 28° C. in a liquid YEP medium (10 g/l yeast extract, 10 g/l Bactopeptone, and 5 g/l NaCl, pH 7.0) in the presence of 50 µg/l kanamycin is resuspended in an inoculation medium (12.5 mM 2-mM 2-(N-morpholino) ethanesulfonic acid, MES, 1 g/l $NH_4Cl$ and 0.3 g/l $MgSO_4$ at pH 5.7) to reach a final concentration of 4.0 at OD 600. Particle-bombarded explants are transferred to GBA medium (374 E), and a droplet of bacteria suspension is placed directly onto the top of the meristem. The explants are co-cultivated on the medium for 4 days, after which the explants are transferred to 374 C medium (GBA with 1% sucrose and no BAP, IAA, GA3 and supplemented with 250 µg/ml cefotaxime). The plantlets are cultured on the medium for about two weeks under 16-hour day and 26° C. incubation conditions.

Explants (around 2 cm long) from two weeks of culture in 374 C medium are screened for a modulation in meristem development (i.e., an alteration of size and appearance of shoot and floral meristems). After positive explants are identified, those shoots that fail to exhibit modified NUE activity are discarded, and every positive explant is subdivided into nodal explants. One nodal explant contains at least one potential node. The nodal segments are cultured on GBA medium for three to four days to promote the formation of auxiliary buds from each node. Then they are transferred to 374 C medium and allowed to develop for an additional four weeks. Developing buds are separated and cultured for an additional four weeks on 374 C medium. Pooled leaf samples from each newly recovered shoot are screened again by the appropriate protein activity assay. At this time, the positive shoots recovered from a single node will generally have been enriched in the transgenic sector detected in the initial assay prior to nodal culture.

Recovered shoots positive for modified NUE expression are grafted to Pioneer hybrid 6440 in vitro-grown sunflower seedling rootstock. The rootstocks are prepared in the following manner. Seeds are dehulled and surface-sterilized for 20 minutes in a 20% Clorox bleach solution with the addition of two to three drops of Tween 20 per 100 ml of solution, and are rinsed three times with distilled water. The sterilized seeds are germinated on the filter moistened with water for three days, then they are transferred into 48 medium (half-strength MS salt, 0.5% sucrose, 0.3% gelrite pH 5.0) and grown at 26° C. under the dark for three days, then incubated at 16-hour-day culture conditions. The upper portion of selected seedling is removed, a vertical slice is made in each hypocotyl, and a transformed shoot is inserted into a V-cut. The cut area is wrapped with parafilm. After one week of culture on the medium, grafted plants are transferred to soil. In the first two weeks, they are maintained under high humidity conditions to acclimatize to a greenhouse environment.

Example 8

Rice Tissue Transformation

Genetic Confirmation of the NUE gene

One method for transforming DNA into cells of higher plants that is available to those skilled in the art is high-velocity ballistic bombardment using metal particles coated with the nucleic acid constructs of interest (see, Klein, et al., *Nature* (1987) (London) 327:70-73, and see U.S. Pat. No. 4,945,050). A Biolistic PDS-1000/He (BioRAD Laboratories, Hercules, Calif.) is used for these complementation experiments. The particle bombardment technique is used to transform the NUE mutants and wild type rice with DNA fragments The bacterial hygromycin B phosphotransferase (Hpt II) gene from *Streptomyces hygroscopicus* that confers resistance to the antibiotic is used as the selectable marker for rice transformation. In the vector, pML18, the Hpt II gene was engineered with the 35 S promoter from Cauliflower Mosaic Virus and the termination and polyadenylation signals from the octopine synthase gene of *Agrobacterium tumefaciens*. pML18 was described in WO 97/47731, which was published on Dec. 18, 1997, the disclosure of which is hereby incorporated by reference.

Embryogenic callus cultures derived from the scutellum of germinating rice seeds serve as source material for transformation experiments. This material is generated by germinating sterile rice seeds on a callus initiation media (MS salts, Nitsch and Nitsch vitamins, 1.0 mg/l 2,4-D and 10 µM $AgNO_3$) in the dark at 27-28° C. Embryogenic callus proliferating from the scutellum of the embryos is the transferred to CM media (N6 salts, Nitsch and Nitsch vitamins, 1 mg/l 2,4-D, Chu, et al., 1985, *Sci. Sinica* 18: 659-668). Callus cultures are maintained on CM by routine sub-culture at two week intervals and used for transformation within 10 weeks of initiation.

Callus is prepared for transformation by subculturing 0.5-1.0 mm pieces approximately 1 mm apart, arranged in a circular area of about 4 cm in diameter, in the center of a circle of Whatman #541 paper placed on CM media. The plates with callus are incubated in the dark at 27-28° C. for 3-5 days. Prior to bombardment, the filters with callus are transferred to CM supplemented with 0.25 M mannitol and 0.25 M sorbitol for 3 hr in the dark. The petri dish lids are then left ajar for 20-45 minutes in a sterile hood to allow moisture on tissue to dissipate.

Each genomic DNA fragment is co-precipitated with pML18 containing the selectable marker for rice transformation onto the surface of gold particles. To accomplish this, a total of 10 µg of DNA at a 2:1 ratio of trait:selectable marker DNAs are added to 50 µl aliquot of gold particles that have been resuspended at a concentration of 60 mg $ml^{-1}$. Calcium chloride (50 µl of a 2.5 M solution) and spermidine (20 µl of a 0.1 M solution) are then added to the gold-DNA suspension as the tube is vortexing for 3 min. The gold particles are centrifuged in a microfuge for 1 sec and the supernatant removed. The gold particles are then washed twice with 1 ml of absolute ethanol and then resuspended in 50 µl of absolute ethanol and sonicated (bath sonicator) for one second to disperse the gold particles. The gold suspension is incubated at −70° C. for five minutes and sonicated (bath sonicator) if needed to disperse the particles. Six µl of the DNA-coated gold particles are then loaded onto mylar macrocarrier disks and the ethanol is allowed to evaporate.

At the end of the drying period, a petri dish containing the tissue is placed in the chamber of the PDS-1000/He. The air in the chamber is then evacuated to a vacuum of 28-29 inches Hg. The macrocarrier is accelerated with a helium shock wave using a rupture membrane that bursts when the He pressure in the shock tube reaches 1080-1100 psi. The tissue is placed approximately 8 cm from the stopping screen and the callus is bombarded two times. Two to four plates of tissue are bombarded in this way with the DNA-coated gold particles. Following bombardment, the callus tissue is transferred to CM media without supplemental sorbitol or mannitol.

Within 3-5 days after bombardment the callus tissue is transferred to SM media (CM medium containing 50 mg/l hygromycin). To accomplish this, callus tissue is transferred from plates to sterile 50 ml conical tubes and weighed. Molten top-agar at 40° C. is added using 2.5 ml of top agar/100 mg of callus. Callus clumps are broken into fragments of less than 2 mm diameter by repeated dispensing through a 10 ml pipet. Three ml aliquots of the callus suspension are plated onto fresh SM media and the plates are incubated in the dark for 4 weeks at 27-28° C. After 4 weeks, transgenic callus events are identified, transferred to fresh SM plates and grown for an additional 2 weeks in the dark at 27-28° C.

Growing callus is transferred to RM1 media (MS salts, Nitsch and Nitsch vitamins, 2% sucrose, 3% sorbitol, 0.4% gelrite+50 ppm hyg B) for 2 weeks in the dark at 25° C. After 2 weeks the callus is transferred to RM2 media (MS salts, Nitsch and Nitsch vitamins, 3% sucrose, 0.4% gelrite +50 ppm hyg B) and placed under cool white light (~40 $\mu Em^{-2}s^{-1}$) with a 12 hr photoperiod at 25° C. and 30-40% humidity. After 2-4 weeks in the light, callus begin to organize, and form shoots. Shoots are removed from surrounding callus/media and gently transferred to RM3 media (½×MS salts, Nitsch and Nitsch vitamins, 1% sucrose+50 ppm hygromycin B) in phytatrays (Sigma Chemical Co., St. Louis, Mo.) and incubation is continued using the same conditions as described in the previous step.

Plants are transferred from RM3 to 4" pots containing Metro mix 350 after 2-3 weeks, when sufficient root and shoot growth have occurred. The seed obtained from the transgenic plants is examined for genetic complementation of the NUE mutation with the wild-type genomic DNA containing the NUE gene.

Example 9

Variants of NUE Sequences

A. Variant Nucleotide Sequences of NUE That Do Not Alter the Encoded Amino Acid Sequence The NUE nucleotide sequences are used to generate variant nucleotide sequences having the nucleotide sequence of the open reading frame with about 70%, 75%, 80%, 85%, 90%, and 95% nucleotide sequence identity when compared to the starting unaltered ORF nucleotide sequence of the corresponding SEQ ID NO. These functional variants are generated using a standard codon table. While the nucleotide sequence of the variants are altered, the amino acid sequence encoded by the open reading frames do not change.

B. Variant Amino Acid Sequences of NUE Polypeptides

Variant amino acid sequences of the NUE polypeptides are generated. In this example, one amino acid is altered. Specifically, the open reading frames are reviewed to determine the appropriate amino acid alteration. The selection of the amino acid to change is made by consulting the protein alignment (with the other orthologs and other gene family members from various species). An amino acid is selected that is deemed not to be under high selection pressure (not highly conserved) and which is rather easily substituted by an amino acid with similar chemical characteristics (i.e., similar functional side-chain). Using the protein alignment, an appropriate amino acid can be changed. Once the targeted amino acid is identified, the procedure outlined in the following section C is followed. Variants having about 70%, 75%, 80%, 85%, 90%, and 95% nucleic acid sequence identity are generated using this method.

c. Additional Variant Amino Acid Sequences of NUE Polypeptides

In this example, artificial protein sequences are created having 80%, 85%, 90%, and 95% identity relative to the reference protein sequence. This latter effort requires identifying conserved and variable regions from the alignment and then the judicious application of an amino acid substitutions table. These parts will be discussed in more detail below.

Largely, the determination of which amino acid sequences are altered is made based on the conserved regions among NUE protein or among the other NUE polypeptides. Based on the sequence alignment, the various regions of the NUE polypeptide that can likely be altered are represented in lower case letters, while the conserved regions are represented by capital letters. It is recognized that conservative substitutions can be made in the conserved regions below without altering function. In addition, one of skill will understand that functional variants of the NUE sequence of the invention can have minor non-conserved amino acid alterations in the conserved domain.

Artificial protein sequences are then created that are different from the original in the intervals of 80-85%, 85-90%, 90-95%, and 95-100% identity. Midpoints of these intervals are targeted, with liberal latitude of plus or minus 1%, for example. The amino acids substitutions will be effected by a custom Perl script. The substitution table is provided below in Table 2.

TABLE 2

Substitution Table

| Amino Acid | Strongly Similar and Optimal Substitution | Rank of Order to Change | Comment |
|---|---|---|---|
| I | L, V | 1 | 50:50 substitution |
| L | I, V | 2 | 50:50 substitution |
| V | I, L | 3 | 50:50 substitution |
| A | G | 4 | |
| G | A | 5 | |
| D | E | 6 | |
| E | D | 7 | |
| W | Y | 8 | |
| Y | W | 9 | |
| S | T | 10 | |
| T | S | 11 | |
| K | R | 12 | |
| R | K | 13 | |
| N | Q | 14 | |
| Q | N | 15 | |
| F | Y | 16 | |
| M | L | 17 | First methionine cannot change |
| H | | Na | No good substitutes |
| C | | Na | No good substitutes |
| P | | Na | No good substitutes |

First, any conserved amino acids in the protein that should not be changed is identified and "marked off" for insulation from the substitution. The start methionine will of course be added to this list automatically. Next, the changes are made.

H, C, and P are not changed in any circumstance. The changes will occur with isoleucine first, sweeping N-terminal to C-terminal. Then leucine, and so on down the list until the desired target it reached. Interim number substitutions can be made so as not to cause reversal of changes. The list is ordered 1-17, so start with as many isoleucine changes as needed before leucine, and so on down to methionine. Clearly many amino acids will in this manner not need to be changed. L, I and V will involve a 50:50 substitution of the two alternate optimal substitutions.

The variant amino acid sequences are written as output. Perl script is used to calculate the percent identities. Using this procedure, variants of the NUE polypeptides are generating having about 80%, 85%, 90%, and 95% amino acid identity to the starting unaltered ORF nucleotide sequence of SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311 or 313.

Example 10

Transgenic Maize Plants $T_0$ transgenic maize plants containing the NUE construct under the control of a promoter were generated. These plants were grown in greenhouse conditions, under the FASTCORN system, as detailed in US patent publication 2003/0221212, U.S. patent application Ser. No. 10/367,417.

Each of the plants was analyzed for measurable alteration in one or more of the following characteristics in the following manner:

$T_1$ progeny derived from self fertilization each $T_0$ plant containing a single copy of each NUE construct that were found to segregate 1:1 for the transgenic event were analyzed for improved growth rate in low $KNO_3$. Growth was monitored up to anthesis when cumulative plant growth, growth rate and ear weight were determined for transgene positive, transgene null, and non-transformed controls events. The distribution of the phenotype of individual plants was compared to the distribution of a control set and to the distribution of all the remaining treatments. Variances for each set were calculated and compared using an F test, comparing the event variance to a non-transgenic control set variance and to the pooled variance of the remaining events in the experiment. The greater the response to $KNO_3$, the greater the variance within an event set and the greater the F value. Positive results will be compared to the distribution of the transgene within the event to make sure the response segregates with the transgene.

Example 11

Transgenic Event Analysis from Field Plots

Transgenic events are evaluated in field plots where yield is limited by reducing fertilizer application by 30% or more. Improvements in yield, yield components, or other agronomic traits between transgenic and non-transgenic plants in these reduced nitrogen fertility plots are used to assess improvements in nitrogen utilization contributed by expression of transgenic events. Similar comparisons are made in plots supplemented with recommended nitrogen fertility rates. Effective transgenic events are those that achieve similar yields in the nitrogen-limited and normal nitrogen experiments.

All publications and patent applications in this specification are indicative of the level of ordinary skill in the art to which this invention pertains. All publications and patent applications are herein incorporated by reference to the same extent as if each individual publication or patent application was specifically and individually indicated by reference.

The invention has been described with reference to various specific and preferred embodiments and techniques. However, it should be understood that many variations and modifications may be made while remaining within the spirit and scope of the invention.

SEQUENCE LISTING (314 sequences)

SEQ ID NO: 1 - DNA, 915 bp, Zea mays
tagctttcttgttagcctcgaatcgcgatccagtagctcatcaactgattcacaagtgcaagcaattgatgaagaggtttgcagttcaggagagcgagatggcgcgcatgctggtgctcatgtcgcgctcgcacggccagaaccaggcgctgccactgtcggcctgcctcgccggcggccggcgcggcgaggaccggcaggcgccggagcgagtgttcgtgtgcaagacgtgcaaccgcgtgttcccgtcgttccaggcgctgggcggccaccgcgccagccacaagaagccgcggctggacggggacggcggcggcgacccctcgctcgccaagcccaagctgcacggctgctccgtctgcggcctcgagttcgccatcggccaggccctcggcggccacatgaggcgccaccgcgccatgacgggcggcgtgccggcggtgccgcccgcgacgacgaggatcgtcgtcgacgagaagccggacggcgacgtcgtcggcatcatccgccacgaccacggcggcgtcaagcagcccggcggcgggctgtggctcgacctcaactacccgccgtgcgacgacggccgcgacgcggtggaggcggagtgtggccgcaatgccgccgccgccacggggatcacgttccatcagttcctcgacactgccaccatggccgtcgactgccttggctactagatagatagatatataccaccaagctccatgattcttctcccctgccgcgtactactggtgcaccggtctcttcttcttcttctttcttttcttttcttttctggaatcttcttcctcatttgcttctgggcggagggggagaaatccacattttgtagcagtagtagaatgaaggtgcctaatgcatgcatgggcttggctgaaaaaaaaaaaaaaaaaa

SEQ ID NO: 2 - protein, 208 aa, Zea mays
MKRFAVQESEMARMLVLMSRSHGQNQALPLSACLAGGRRGEDRQAPERVFVCKTCNRVFPSFQALGGHRASHKKPRLDGDGGGDPSLAKPKLHGCSVCGLEFAIGQALGGHMRRHRAMTGGVPAVPPATTRIVVDEKPDGDVVGIIRHDHGGVKQPGGGLWLDLNYPPCDDGRDAVEAECGRNAAAATGITFHQFLDTATMAVDCLGY

SEQ ID NO: 3 - DNA, 1110 bp, Zea mays
gttgtgctgctcgctcagacagctctgctagctgcatcctcctaactctccaggtctctctctcctctcccaactcccaagtcccatccggatcgagacgctggaggcggagcgcccccccgggacggcggcggcgacgatggggcgcggcaagatcgagatcaagcggatcgagaacgccaccaaccgccaggtgacctactccaagcgccggacggggatcatgaagaaggcgcgcgagctcaccgtgctctgcgacgcccaggtcgccatcatcatgttctcctccaccggcaagtaccacgagttctgcagccccggaaccgacatcaagaccatctttgaccggtaccagcaggccatcgggaccagcctatggatcgagcagtatgagaatatgcagcgcacgctgagccatctcaaggacatcaatcgtggtctgcgcacagagattaggcaaaggatgggcgaggatctggacagtctggacttcgacgagctgcgcggcctcgagcaaaacgtcgacgcggctctcaaggaggttcgccataggaagtaccatgtgatcagcacgcagactgatacctacaagaaaaaggtgaagcactcgcacgaggcgtacaagaacctgcagcaggagctaggcatgcgggaggacccggcgttcgggtacgtggacaacacgggcgccggcgtcgcctgggacggcgcggcggcggcgctgggcggcgccccgccggacatgtacgccttccgcgtggtgcccagccagcccaacctgcacggcatggcctacggcttccacgacctccgcctgggctagcgcatccatcaccattcatgcatcgtccgtcaacaaagcaagtaagcaatgcaatgcaaccgaggtactgtaatagccaataaaatctactgcatactgcaaacccaattactggtagcttagctaccgcgtgtgtacgaatcaaccgattaattaccgcgcccttagcttgcatgtcgtcgtcgtctgtgcttttggcgttcgtagacatgtgtgtattgtatgcatgggtcctgttcatctgcatccatgcatgttgtttaaaaaaaaaaaaaaaaaaaaaaaaa

SEQ ID NO: 4 - protein, 227 aa, Zea mays
MGRGKIEIKRIENATNRQVTYSKRRTGIMKKARELTVLCDAQVAIIMFSSTGKYHEFCSPGTDIKTIFDRYQQAIGTSLWIEQYENMQRTLSHLKDINRGLRTEIRQRMGEDLDSLDFDELRGLEQNVDAALKEVRHRKYHVISTQTDTYKKKVKHSHEAYKNLQQELGMREDPAFGYVDNTGAGVAWDGAAAALGGAPPDMYAFRVVPSQPNLHGMAYGFHDLRLG

SEQ ID NO: 5 - DNA, 1650 bp, Zea mays
atccaaagaattttgcacacgatagccgcaaccgtgagaggctggtagcccgtagccggcatccctcgccctcgacccatttgaacagggcctcgagctttgcctctgctgctgctcgcttgatccgtctcttgccgtggtacgcgtgctcgatcggcggatcgtcggcggcggcggcgggaagctctccgacccgcggccgggatgggtcggcagccgtgctgcgacaagttgggggtgaagcgggggccgtggacggcggaggaggaccgcaagctcatcaacttcatcctcaccaacggccattgctgctggcgcgcggtgcccaagctcgccggcctgctgcgctgcggcaagagctgccgcctgcgctggaccaactacctccgcccggacctcaagcgcgggctcctcacggacgccgaggagcaggtcgtcatcgacctccacgccaagctcggcaacagatggtcgaagattgctgccaagctaccgggcaggactgacaacgagatcaagaaccactggaacacgcacattaagaagaagctgatcaagatgggcatcgatccagtcacgcacgaacccctcgaccggaagacaaccagcagcggcccggctacaacctctcagtcaaccaagtctgacgaggcgaccaaggagcagagcccgcagaacgacgacgccgtgataagggacgtgccggccgatggttgcagcccgacggaatcgagcacgaacaccgtgagcaccggcggaagcagcagcagtggtggcggcggccatgaccaagacccgctggtgaagtggcttttggaagaggagcctgccaccggcgacgaggcgtggctgaacttcactggcagtgtcgacgtggacgagttcagcagcattgccgccggtccggagttgttgccgtgggatggcgcgaccgactggctgctcgactaccaagattttggattgggggactcgagcttggtcgatggctacatggtcaacaacaacagctcaaacggagcaaagttctagctagctagccgaagatgtcatctcatctgcttgtgttgctttgctgccagtgaacgtagatacgtaagtaataaaagcattggtatcgaggttgtcaaaggtggatgaccacatcgcaggaagatcatgaagagtccttgcacgcactcctgtatctcgaaccaactaacggctgggatgcaattgagaaggggaggagcacaggccaatcaatctcaaagagataaaactggttcttgaagatctcgaagaaagatgtgtttcttcacaatcacaaagagaggttgtagaagttcttgctgttgtatacatggttgcgtatatattgctaaattgtaccttgttaggccattttgttcgcaaattgcacgagtcactaattagtcagcaaaaatgtgtgcataaagaagagcagttgaaatcgcctctttgtacgttgtgggtgacgttcttttagttacgttgtggatgacgttgatgcatttatagggtatttggtttgaggaataagttatctggtttgtagaatggaataagttatccatcatcacctcattaatcatggttagtactaacatgagtaattgagtcattccaccaaaaaaaaaaaaaaaaaaa

SEQ ID NO: 6 - protein, 275 aa, Zea mays
MGRQPCCDKLGVKRGPWTAEEDRKLINFILTNGHCCWRAVPKLAGLLRCGKSCRLRWTNYLRPDLKRGLLTDAEEQVVIDLHAKLGNRWSKIAAKLPGRTDNEIKNHWNTHIKKKLIKMGIDPVTHEPLDRKTTSSGPATTSQSTKSDEATKEQSPQNDDAVIRDVPADGCSPTESSTNTVSTGGSSSSGGGGHDQDPLVKWLLEEEPATGDEAWLNFTGSVDVDEFSSIAAGPELLPWDGATDWLLDYQDFGLGDSSLVDGYMVNNNSSNGAKF

SEQ ID NO: 7 - DNA, 1260 bp, Zea mays
ctccttggcttttcctctcgctctcctcctctctcgcatcccaccgcatcacaaccacgacttcctcccgccgccggttggcttcgctgctcgtccacctccgcccggcccgtgggacgagtggggactggagagggtcgcctctgggcttcgcctctcggcggccgagtgtctgcgtcgtccacggagctgagagcctgagactgagactgagagcgaccggcggcggggatggcgagggagaggcgggagataaagaggatagagagcgcggcagcgaggcaggtcacgttctccaagcgccgccgcggcctcttcaagaaggcccaggagctctccgtgctgtgcgatgccgacgtcgcgctcatcgtcttctcctccacggggaagctctcccagttcgccagctccagtatgaatgagataattgacaagtacaacacgcattctaaaaacctggggaaaacagaacagccttcgctggacttgaacttagagcatagcaaatatgcaaatttgaatgagcaacttgcggaagcaagccttcgactcaggcagatgagaggtgaagaacttgagggattgaatgttgaagaactccagcagttggagaagaacctggaatctggtctgcatagggtgcttcaaacaaaggatcaacaattcttggaacagatcaatgacctcgaacgtaagagtacgcagctggcagaggagaacatgcaactgaggaatcaagtatcccagatacccccagctggcaagcaagcagttgctgatactgaaaatgttattgctgaagaagggcaatcctctgaatcagtgatgactgcgttgcactctgggagttcacaggataatgatgatggttcggatgtatctctaaagttagggctgccttgcgttgcatggaagtaaacaggaaatgaggctccttgtcgattctgggtgtggatgtgggtgtgggtggagctgcggcctcagcggataggcacttgtgtatggttttatggacgaccggcccccgactacgtactgcaataatcttgcattggaagcgagatcggttaacctgatttgtcatccttgtggcttcatgatgcgatgttccgcttgtaccgtttgctagcatgttaactgaatttttagaatcgcatatacttttgttcttatatatcactgtcgtactgctcgtaagatgtatctactttattctatccaatgttgtaacctatcacctaccaaaaaaaaaaaaaaaaa

SEQ ID NO: 8 - protein, 228 aa, Zea mays
MARERREIKRIESAAARQVTFSKRRRGLFKKAQELSVLCDADVALIVFSSTGKLSQFASSSMNEIIDKYNTHSKNLGKTEQPSLDLNLEHSKYANLNEQLAEASLRLRQMRGEELEGLNVEELQQLEKNLESGLHRVLQTKDQQFLEQINDLERKSTQLAEENMQLRNQVSQIPPAGKQAVADTENVIAEEGQSSESVMTALHSGSSQDNDDGSDVSLKLGLPCVAWK

SEQ ID NO: 9 - DNA, 1270 bp, Zea mays
gcacaagcttcctccccctccgcgccgctcctccaggctccagccatggcgatcgccaccgagtcgcgcggctgcgaggacagggattcagcccatgcaaacgaggagaagcggtgggtgctgtctgatttcgaggttgggaagcctcttgggaggggcaaattcggccacgtatatcttgccagagaaaagaggagcaatcaaattgtggctttgaaagttcttttcaagagccagcttaagcaatcacaggtcgagcatcagctgcgacgcgaagtggagattcagagtcatcttcgtcatcctaatattcttcgcctgtatgggtacttctatgatcagacccgggtttacctaatcctggaatatgctgccaagggtgagctgtataaggaactgacaaggtgtaaacatttttctgagagacgttcagcaacttatattgcatcattggctagagctctgatctacctgcatgggaagcatgttatccatcgggacattaaaccagaaaatcttttggttggagcccagggcgagatcaaaatcgccgactttggctggtctgtgcataccttcaacagaagaaggactatgtgcggaactctggattacctgccacctgaaatggtggagaagacagaacatgattaccatgttgacatatggagcctgggtattctgtgttatgagttcctttacggggtcccaccttttgaagctaaggagcactcagaaacatacagaaggatagtaaaagtcgacttgaagttcccactgaaaccattcgtttcgcccgctgcaaaggatttgatttcccagatgctggtcaagaactcggcccagcggctgcctctccacaaggttcttgagcacccatggatcgtccagaacgccgacccttccggtgtgtgcagaggatagaaccaccaccaccggctgaagggagtgcgattctttccactctccccatttcgaggggagtgcgattctttcgactgtttatggcttctgtcgcccgaattgccccaccccgaactgtatcttgtagcaccgtgtactgtgtgtagttggggccgtgggcaaattgccctaaacccttgaacaaccttctttactcgtagtctcgtatgagagagccttgtagagtctcgtccgtccaattatgaactccagggcaatgtgcaggaaaatgttgaaggtatcgtccataaccagcaaaacttatgtagcgagctcaatttagaatttaaaaaaaaaaaaaaaaaaa

SEQ ID NO: 10 - protein, 292 aa, Zea mays
MAIATESRGCEDRDSAHANEEKRWVLSDFEVGKPLGRGKFGHVYLAREKRSNQIVALKVLFKSQLKQSQVEHQLRREVEIQSHLRHPNILRLYGYFYDQTRVYLILEYAAKGELYKELTRCKHFSERRSATYIASLARALIYLHGKHVIHRDIKPENLLVGAQGEIKIADFGWSVHTFNRRRTMCGTLDYLPPEMVEKTEHDYHVDIWSLGILCYEFLYGVPPFEAKEHSETYRRIVKVDLKFPLKPFVSPAAKDLISQMLVKNSAQRLPLHKVLEHPWIVQNADPSGVCRG

SEQ ID NO: 11 - DNA, 1837 bp, Zea mays
gaggataccttcactgctctgcggctgctccgccacgccgccgtccatcgtccatcgtccatggcgtcaccgcaccttcctttcctctccttccccaaaacattaccgccgctacctcccccactcaagacccacgcccaccgcacctccctagccgccgctcctgctccgccgcccgccccgcctgacggcgcggggcccgccgcgcccacgcgtggggaccgcttcctcggccgccagctggccaccgaggccgccgcgcgcgtgctcgcgcccgaggacgccgacaggcggcgccgacgcaaggagaagcgccgggccttggcacggaagccctccggcctcgcatcctgctacggctgcggcgccccgctgcagacggcggaggaggccgcgccgggatacgtcgacccggacacgtaccaactgaagaagaggcatcaccaacttagaaccgttctatgtgggaggtgcaagctgctgtctcatggccacatggttactgctgttggtggccacggcggttatccagggggcaagaagtttgtttctgcggaacagctcagggagaagctgtcatacctccgtcacgagaaagcgctcatagtcaaattggttgacatcgttgacttcaatggaagtttcctggcacgtgtacgcgattttgctggtgctaatcctattatacttgtgataacaaaggttgatctccttcccagagatactgatttgaattgtataggcgactgggttgtcgagtcagttgtcaagaagaagcttaacgtccttagtgtccatttgacaagctcaaagtcattggtcggtatcacaggggttatatcagagattcatcaggaaaggaagggccgagatgtatatatactgggttccgcaaatgttggaaaatctgcatttatcagtgcaatgctaagaacaatggcgtacaaggacccggtagcagcggcagctcaaaaatacaagccaatacagtctgctgttcctggaacaacccttggccctattcaaattgaagcatttttaggcggagggaaattgtatgatacacctggagtccaccttcaccataggcaggcagcagttatccatgctgatgatctgccttctcttgcaccacaaagtcgtttgaaagggcgatgttttccggctaatgatacagatgttgaattgagcgggaattcattgttctgggctgggctagtccgcattgatgttatcaaggctcttccacgttcacggctgacattctatgggcccaagaagctaaagattaatatggtcccgacaacagaagctgatcaattttacgagactgaagttggggtcacattgactccgccaactggtaaggagagagctgaaggatggacagggcttcaaggggttcgcgagttgaagataaaatatgaggaacgtgacaggcctgcctgtgacatcgcgatctctgggcttgggtggatttctgtggagccatcaggtgtgccttcaaacagcgctgaggaagtttatgatggcggtgagctgcatctggtggtacatgtgcccaaaccggttgaggtcttcatgcgtcctccattacctgtcggcaaagcagcgtcgcaatggtaccggtatcaagagctgacagaggaagaagaggagctgaggcctaaatggcattactgatgctgctctgtttctctagggctggctctagcagtagtacagatttctgtaatccaaatatttagcagagtgttaggacctggtgatgaaatggattcagaaaacaagttttgaataaatctgtctctggtggtgtctatttagcactttgctt

SEQ ID NO: 12 - protein, 540 aa, Zea mays
MASPHLPFLSFPKTLPPLPPPLKTHAHRTSLAAAPAPPPAPPDGAGPAAPTRGDRFLGRQLATEAAARVLAPEDADRRRRRKEKRRALARKPSGLASCYGCGAPLQTAEEAAPGYVDPDTYQLKKRHHQLRTVLCGRCKLLSHGHMVTAVGGHGGYPGGKKFVSAEQLREKLSYLRHEKALIVKLVDIVDFNGSFLARVRDFAGANPIILVITKVDLLPRDTDLNCIGDWVVESVVKKKLNVLSVHLTSSKSLVGITGVISEIHQERKGRDVYILGSANVGKSAFISAMLRTMAYKDPVAAAAQKYKPIQSAVPGTTLGPIQIEAFLGGGKLYDTPGVHLHHRQAAVIHADDLPSLAPQSRLKGRCFPANDTDVELSGNSLFWAGLVRIDVIKALPRSRLTFYGPKKLKINMVPTTEADQFYETEVGVTLTPPTGKERAEGWTGLQGVRELKIKYEERDRPACDIAISGLGWISVEPSGVPSNSAEEVYDGGELHLVVHVPKPVEVFMRPPLPVGKAASQWYRYQELTEEEEELRPKWHY

SEQ ID NO: 13 - DNA, 1537 bp, Zea mays
cctcccctccccggcccgacgcccctcgccccccccctcctgaccagccatggcgaccgctgctgctgcgtcccgggtggctgtctcggcgccggtcttcggttcggacggcggcgccaggagctccgggatcaagggcaacaacaatgttagcttcggcagcaaatcatgggtcggcggcacattggcctgggagagcagctgctcggtgcggcccaggcgcgccagcaaggtgctctgcatgtccgtccagcaggcgagcaggagtaaggtctccgtcgcgccgctccatctcgagagcgccaaggagccacctctcaacacgtacaagcccaaggagcccttcacggccaccattgtctcggtggagagtctggtcggccccaaagctccgggggagacttgccacatcgttatcgaccatggtggcaatgtgccgtactgggagggccagagctacggcgtcattcctcctggagaaaatcctaaaaagcctggagccccacaaaatgtccggctttattcaattgcatcgactaggtatggagataactttgatgggcgaaccggaagcttgtgtgtccgccgtgcagtttattatgatcctgagactggcaaggaggacccctcaaagaatggtgtctgcagtaatttcctgtgcaactcaaaacctggggacaagattcaattaacaggtccctccggcaaaataatgcttctgcctgaggaggatccaaacgcaacccatatcatgattgccacgggcaccggtgttgcccccttccgtgggtacctgcgccgcatgttcatggaagatgtcccgaactacagatttggtggcttggcctggctcttcctcggcgttgccaattcagacagccttctgtatgacgaagaattcaccagctatcttaagcagtatccagacaatttcaggtacgacaaagccctcagcagggagcagaagaacaggagcggcggcaagatgtacgtccaggacaagatcgaggagtacagcgacgagatcttcaagctcctggacggcggcgcgcacatctacttctgcggtttgaaggggatgatgcctggaatccaggacacccttaagaaggtggcggagcggagaggcgagagctgggaccagaagctggcccagctcaagaagaacaagcaatggcacgtcgaggtctactagggctcggattgctgtggttgcgacccttgatgctgccggggcagcgtcaggagacaaacacatgattgaaattgaatcgatggatggttctcggggcggtgtaaagtcacaaaagttccctttgtgagaaaaatcgccttttgtaattcataaaagcttccgcgccacggttatccgtggaacggaccgtgtaactttcagccgtttacatttgcagtgcagttgcttttggcagtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14 - protein, 381 aa, Zea mays
MATAAAASRVAVSAPVFGSDGGARSSGIKGNNNVSFGSKSWVGGTLAWESSCSVRPRRASKVLCMSVQQASRSKVSVAPLHLESAKEPPLNTYKPKEPFTATIVSVESLVGPKAPGETCHIVIDHGGNVPYWEGQSYGVIPPGENPKKPGAPQNVRLYSIASTRYGDNFDGRTGSLCVRRAVYYDPETGKEDPSKNGVCSNFLCNSKPGDKIQLTGPSGKIMLLPEEDPNATHIMIATGTGVAPFRGYLRRMFMEDVPNYRFGGLAWLFLGVANSDSLLYDEEFTSYLKQYPDNFRYDKALSREQKNRSGGKMYVQDKIEEYSDEIFKLLDGGAHIYFCGLKGMMPGIQDTLKKVAERRGESWDQKLAQLKKNKQWHVEVY

SEQ ID NO: 15 - DNA, 2033 bp, Zea mays
caccaccacagcacagggacagcagcagtgccaccgccaccaccaacaccaaccatggcctccacagcgtccctgcagcgcttcctgcccgcctccccgcacttgtcgtcccggcgccgcgccggccgcgcccgagcggccgtctccatcccgtcgtcgtccccgccggcgacacgggataatgaggtccccgcggagcggctggagccgagggtcgaggcgcgggagaaagggtactggtccctcaaggagaggtaccggaccgggctgaacccgcacgagaaggtgaagctggagaaggagcccatggcgctgttcatggacggcggcgtcagggacctcgccaagatccccatggacgtgatcgacgccgccaagctcaccaaggacgacgtcgacgtccgcctcaagtggctcggcctcttccaccgccgcaagcaccagtacgggcgcttcatgatgcggctgaagctgcccaacggcgtgacgacgagcgagcagacgcggtacctggcgagcgtcatcgaggcgtacggcgccgacgggtgcgcggacgtgacgacccggcagaactggcagatccgcggggtgacgctcccggacgtcccggccatcttggacggcctccgcgccgtcggcctcaccagcctgcagagcggcatggacaacgtgcgcaaccccgtcggcaacccgctcgccggcgtcgacccccacgagatcgtcgacacgcgcccctacaccaacctgctctcctcctacatcacaagcaactcccaggggaaccccgccatcaccaacctgccgaggaaatggaacgtgtgcgtgatcggctcgcacgacctgtacgagcacccgcacatcaacgacctcgcctacatgccggccgtcaaggacggcaagttcggcttcaaccttctggtgggcgggttcatcagccccaagcggtgggccgaggccctgccgctcgacgcctgggtcgccggagacgacgtcgtccccgcgtgcaaggccatcctcgaggcgtacagggacctcgggttcaggggcaaccggcagaagacgcgcatgatgtggctcatcgacgaactcgggatggaggtgttccggtcggaggtggagaagcggatgcccaacggggtgctggagcgcgccgcggcggaggacctcgtcgacaagaagtgggaccggcgggactacctcggcgtgcacccgcagaagcaggaaggcctgtcgtacgtgggcctgcacgtgcccgtgggccggctgcaggccgcggacatgttcgagctggcgcgcctcgccgacgagtacggcacgggcgagctccggctcacggtggagcagaacgtcgtgctccccaacgtgagcaaccggaggctggacgcgctgctcgcggatccgctgctgcagcggcagcgcctctcgccgcagccgtcgctgctgctccggggcctggtggcgtgcacgggcaaccagttctgcgggcaggccatcatcgagaccaaggcgcgggcgctgcaggtggcgcgggaggtggagaagcgcgtggccgtgccgcggccggtgcgcatgcactggaccggatgccccaacagctgcgcccaggtgcaggtggcggacatcggcttcatgggctgcctcaccaaggaccgcgacggcaaggtcgtcgaggccgcggacatcttcgtgggcggccgcgtcggcagcgactcgcacctggcggacgtctacaggaagtccgtgccgtgcaaggacctggtgcccatcgtggccgaccttctggtggagcggttcggggccgtgcccagggagagggaagaggaggatgaggagtaggagcagtggagcacagacttcccggtgaccatccacggtttgttgtaaagtagacgcgctgcctttttccatggcacgatttgttttggtattgtcgtagcaacaaaatgtccccttattcacgtcacagagaataagtaacacgtttcactgtcaaaaaaaaaaaaaaaaaaaaaaaaaaaaaaaaaaaaaaaaaa

SEQ ID NO: 16 - protein, 593 aa, Zea mays
MASTASLQRFLPASPHLSSRRRAGRARAAVSIPSSSPPATRDNEVPAERLEPRVEAREKGYWSLKERYRTGLNPHEKVKLEKEPMALFMDGGVRDLAKIPMDVIDAAKLTKDDVDVRLKWLGLFHRRKHQYGRFMMRLKLPNGVTTSEQTRYLASVIEAYGADGCADVTTRQNWQIRGVTLPDVPAILDGLRAVGLTSLQSGMDNVRNPVGNPLAGVDPHEIVDTRPYTNLLSSYITSNSQGNPAITNLPRKWNVCVIGSHDLYEHPHINDLAYMPAVKDGKFGFNLLVGGFISPKRWAEALPLDAWVAGDDVVPACKAILEAYRDLGFRGNRQKTRMMWLIDELGMEVFRSEVEKRMPNGVLERAAAEDLVDKKWDRRDYLGVHPQKQEGLSYVGLHVPVGRLQAADMFELARLADEYGTGELRLTVEQNVVLPNVSNRRLDALLADPLLQRQRLSPQPSLLLRGLVACTGNQFCGQAIIETKARALQVAREVEKRVAVPRPVRMHWTGCPNSCAQVQVADIGFMGCLTKDRDGKVVEAADIFVGGRVGSDSHLADVYRKSVPCKDLVPIVADLLVERFGAVPREREEEDEE

SEQ ID NO: 17 - DNA, 1821 bp, Zea mays
cccaaagcccaaacgcaacgcctacaaagctacaccgcctcccgcttccttctccgccatacctcgtgtccgacgagccctagggaacgcgagaccggccgtcggcgagagaaggactcgaatggagtgcgcaagggagttgcgggttcgctccacgtttacggcggcggccatggcgtccaagaagcaggtggggcctggaggcgcggttcccgctcaggaacagatgaacggcggcgatgccgccagactggtcaggaagccaatggatacatttccacagccagcggcggcaagaggccgtagggcacttgtcgacgttggcaatcttatgaatggccggccttctcttgtgaaccatcagaagcaagcggttgcggcagcggcaaccagtcataaaccactcaacgtcggcaacaagaagccacttgttcctcaggcagcagcaagaggcctgcgaccccttgccgacgttacgaatcttatgatcaaagaccgtgctgctcctgcaaatcgtcagaagcctgtggatgctgtgtttaacaggaacgggaaggcagtaaagctgaaggaatgcaaggtgaagcctgaagtcattgtgatcattccagattccgagaaggagaagaaaggcaaattccctggaggtcagagagtctgtaggagggtgccaacactttttgacaattttacaaaatgcagcagggcctctgatgggattaccaccccgaagaagaaggatccatatgacattgatgcacctgattcttgcaatgagctggcagtcgttgaatatgttgagcacatttacagattctacaagagcactgagggcacctgccttcctctcagcagctacatgagctcacaggctgaaatcagtgagagaatgagagctatccttatcgactggattatcgaggtacagtacaggcttactctaatgccagagacactttacttgaccgtctacatcatcgaccagtacttatctatggagagtgtaccaagaaaggagctacagctcgtcggcataagtgccatgctgatagcaagcaagtacgaagagatatgggctccactggttaaggacttgatgtgcctctgtgacaacgcatttaccagagaccaggttctgaccaaggaaaaggccatcctggacaggctccattggaacctgacggttccaacaatgtacatgttcattgttaggtacctgaaagccgcaatgtgtgacacagagcttgagaacatggcattcttctactccgagctggcattggtccattacgcgatgctggtttaccctccatcggtgaccgcagccgctgccgtctatgctgccaggtctacacttgggatgaatccaccgtggactgatattctggaacatcacactggcctagctgagccacagttactggactgcgctaggcggcttatcagcttccatgccctggctccggaaagcaagcagaagccggtgtacaggaagtactccaagcccaagctcggctccgtcgcgcttcaatcccctgacaagaagctgttgtcaggttgaggctcgctgctgctcattgtattgtatatcatcgcttcgatggtaccatttgtttgggtcgtgtgctcttatgcttttctactgaagcagagcatgtgttggttagtcagtttgcttaaacgactactgaagcagagccttgtatgtgtgttgggagaatgtgatatgtgatgtcaagctcaaacttcttctcatcattggataaactacttgttggcgtggcaaaaaaaaaaaaaaaaaaaaaaaaaaaaaaaaaaaaa

SEQ ID NO: 18 - protein, 479 aa, Zea mays
MECARELRVRSTFTAAAMASKKQVGPGGAVPAQEQMNGGDAARLVRKPMDTFPQPAAARGRRALVDVGNLMNGRPSLVNHQKQAVAAAATSHKPLNVGNKKPLVPQAAARGLRPLADVTNLMIKDRAAPANRQKPVDAVFNRNGKAVKLKECKVKPEVIVIIPDSEKEKKGKFPGGQRVCRRVPTLFDNFTKCSRASDGITTPKKKDPYDIDAPDSCNELAVVEYVEHIYRFYKSTEGTCLPLSSYMSSQAEISERMRAILIDWIIEVQYRLTLMPETLYLTVYIIDQYLSMESVPRKELQLVGISAMLIASKYEEIWAPLVKDLMCLCDNAFTRDQVLTKEKAILDRLHWNLTVPTMYMFIVRYLKAAMCDTELENMAFFYSELALVHYAMLVYPPSVTAAAAVYAARSTLGMNPPWTDILEHHTGLAEPQLLDCARRLISFHALAPESKQKPVYRKYSKPKLGSVALQSPDKKLLSG

SEQ ID NO: 19 - DNA, 908 bp, Zea mays
cactttctgtcagcttcctcccctgcgccgataagcaagcccgtgagccaacagtggtgccagcggcccgagcggcgaggatgcacagcggagcgaggaagctcatgtgggggaccagcccggacaggcccgacgaccacgacgtggtcatcgtgctcgcctcgctgctgtgcgcgctcatcaccgtcctcggcatcggcctcgtggcgcggtgcgcgtgcgcgcgcgggcccagcgcgcaggcggcggctgccgccaacaggggcgtcaagaagtcggtgctgcgcaggatccccaccgtgccctacgccgcctgcagccaaggggaaggggacgacgcggacgagtgcgccatctgcctggcggagttcgaggagggcgagcccacgcgcgtgctgccccagtgcggccacgccttccacgccgcctgcgtcgacaggtggctgcgcgcccactcgtcctgcccctcctgccgccgcatcctctccctccagctgccgcccggcgagcggtgccgccgctgcggcgcgcggcccctggacgacggggacgctgggtggaagcccacctactacagcgccatgccgccgttcctggcgtaagcggcggaggaatcgcccgatccggaagcaaaggaaagcaaagcaaagcaaaccttcgggttaagttcctcggctgcagatttcggtactgcctgtatgtggttggtagtgcgtagcaatctgggaatgaggaaaattaggggatcaattaggttgtttgttgcagctgaaaacactgcactgcagcgtgcgtagtagtagtactagtaccaggctggcgtgtacagtacagtttgtaaatactcaagtaattaatatgcatgcgatgagctttggtatggatgatctccgcctcgtgccgaattc

SEQ ID NO: 20 - protein, 173 aa, Zea mays
MHSGARKLMWGTSPDRPDDHDVVIVLASLLCALITVLGIGLVARCACARGPSAQAAAAANRGVKKSVLRRIPTVPYAACSQGEGDDADECAICLAEFEEGEPTRVLPQCGHAFHAACVDRWLRAHSSCPSCRRILSLQLPPGERCRRCGARPLDDGDAGWKPTYYSAMPPFLA

SEQ ID NO: 21 - DNA, 2021 bp, Zea mays
gcagcagcgcgccccctccccgccccacaataaaacagccacacgctcgccacccatggccaccaccaccaccaccaccacagcacaggcccactgccaccgctaccgctaaccatggcctcctcagcgtccctgcagcggttcctcctgccctcctcgcacgcggcggcgacggcggcctcgccgtcctcccggctgcgccgcacagggcgcgcccgcgcggccgtctccgtgccgccgccggcggcggcgggggagcaggtcccgacggagcggctggagccgagggtcgaggagcgggcgggcgggtactgggtcctcaaggagaagtaccgggcggggctgaacccgcaggagaaggtgaagctggagaaggagcccatggcgctgttcatggagggcggcatccaggacctggccagggtccccatggagcagatcgacgccgccaagctcaccaaggacgacgtcgacgtccgcctcaagtggctcggcctcttccaccgccgcaagcaccagtacgggcggttcatgatgcggctgaagctgcccaacggcgtgacgacgagcgagcagacgcggtacctggcgagcgtcatcgaggcgtacggcgccgacgggtgcgcggacgtgaccacccggcagaactggcagatccgcggggtgacgctcccggacgtcccggccatcctggacggcctccgcgccgtcggcctcaccagcctgcagagcggcatggacaacgtgcgcaaccccgtcggcaacccgctcgccggcgtcgacccccacgagatcgtcgacacgcgcccatacaccaacctgctctcctcctacgtcaccaacaactcccaggggaaccccaccatcaccaacctgccgaggaaatggaacgtctgcgtcatcggctcgcatgacctgtacgagcacccgcacatcaacgacctcgcgtacatgccggccgtcaaggacggcgagttcggcttcaaccttctggtgggcgggttcatcagccccaagaggtgggccgaggcgttgccgctcgacgcctgggtcgccggggacgacgtcgtccccgtgtgcaaggccatcctcgaggcgtaccgggacctcggctccaggggcaaccggcagaagacgcgcatgatgtggctcatcgacgagctcgggatggaggtgttccggtcggaggtggagaagaggatgccgaacggggtgctggagcgcgccgcgccggaggacctcgtcgacaagcgctgggagcggcgggactacctcggcgtgcacccgcagaagcaggaaggcctgtcgtacgtgggcctccacgtgcccgtgggccggctgcaggccgcggacatgttcgagctggcgcggctcgccgacgagtacggcaccggcgagctccggctcacggtggagcagaacatcgtgctccccaacgtcagcaacgagaggctcgacgcgctgctggcggagccgctgctgcaggagcagcggctctcgccgcggccgtcgatgctgctcagggggctggtggcgtgcacgggcaaccagttctgcgggcaggccatcatcgagaccaaggcgcgggcgctgcaggtggcgcgggaggtggagaagcgcgtggccgtgccgcggccggtccgcatgcactggaccggatgccccaacagctgcggccaggtgcaggtggcggacatcggcttcatgggctgcctcaccaaggacagcgacggcaagatcgtcgaggccgcggacatcttcgtgggcggccgcgtcggcagcgactcgcacctggccgacgtctaccggaagtccgtgccgtgcaaggacctggtgcccatcgtggccgacctcttggtggagcggttcggggccgtgccgagggagagggaggaggatgaggagtaggaccttcgtcaagcgccggctgggactgtcctgacctattttatgaggtcttgattggatgtatatatattcatcttaatctatatggatttctgaaaaaaaaaaaaaaaaaa

SEQ ID NO: 22 - protein, 597 aa, Zea mays
MASSASLQRFLLPSSHAAATAASPSSRLRRTGRARAAVSVPPPAAAGEQVPTERLEPRVEERAGGYWVLKEKYRAGLNPQEKVKLEKEPMALFMEGGIQDLARVPMEQIDAAKLTKDDVDVRLKWLGLFHRRKHQYGRFMMRLKLPNGVTTSEQTRYLASVIEAYGADGCADVTTRQNWQIRGVTLPDVPAILDGLRAVGLTSLQSGMDNVRNPVGNPLAGVDPHEIVDTRPYTNLLSSYVTNNSQGNPTITNLPRKWNVCVIGSHDLYEHPHINDLAYMPAVKDGEFGFNLLVGGFISPKRWAEALPLDAWVAGDDVVPVCKAILEAYRDLGSRGNRQKTRMMWLIDELGMEVFRSEVEKRMPNGVLERAAPEDLVDKRWERRDYLGVHPQKQEGLSYVGLHVPVGRLQAADMFELARLADEYGTGELRLTVEQNIVLPNVSNERLDALLAEPLLQEQRLSPRPSMLLRGLVACTGNQFCGQAIIETKARALQVAREVEKRVAVPRPVRMHWTGCPNSCGQVQVADIGFMGCLTKDSDGKIVEAADIFVGGRVGSDSHLADVYRKSVPCKDLVPIVADLLVERFGAVPREREEDEE

SEQ ID NO: 23 - DNA, 811 bp, Zea mays
gcgaaacgaggccaccagctcaccgccgagcggaagcggcgccgagcaaccaacccctctcctcgtccgccgccgtctccccggaccatggccttccccaccgtgctgaaggatctgatgtatgctgactctcatgaatgggtgaaagttgagggtgattcagcaaccgtggggattactgactacgcccagtatcaattgggtgagcttgttgttgtggagctaccagaagttggcatcagtgtatcccagggaaagacctttggttctgttgagagtgtgaatggagccagcgatatctattcaccagtgtctggagaggtggttgaagtgaacgagaaactaagtgacttgcctggagtggtgaatacaagtccatatgagaagggatggattatgaaggtcaagctcagcaattcaggtgagctcaattcgctcatggatgatgacaagtactcgaaatactgcgaagaaggcaaccattgaagaaatcggagtgtcttctgaggaccaggacctgtttttcaagctttatcaattatcactggttatggtctggagaccagttgtgacaaattggcaaggttcatcgcaaggaataaatgttaggatttgccaatcctacgagggcatgggaaatccaagtttgtgttgtcaatgacgtggtcatatttgatatttctttgtagttgtaatctcgtgaattccttctttttcttaaaaaggactctttttgattccttcctatgcaaatttcttggtgcttttgcgaatggttaagatttttcagcaaaaaaaaaaaaaaaaaaaa

SEQ ID NO: 24 - protein, 132 aa, Zea mays
MAFPTVLKDLMYADSHEWVKVEGDSATVGITDYAQYQLGELVVVELPEVGISVSQGKTFGSVESVNGASDIYSPVSGEVVEVNEKLSDLPGVVNTSPYEKGWIMKVKLSNSGELNSLMDDDKYSKYCEEGNH

SEQ ID NO: 25 - DNA, 710 bp, Zea mays
  misc_feature 651: n = A,T,C or G
ttaaaagatccgctactagtgtcaccggcaacgtgtcgacgcggtcgtgtggggaggaagcgaaccctgcttggtgcttgcttgccggacaagaagtgagaacagcgtgggtgcggaagcgaccggaccgaggatggctacaagaaggaccgtggcggcgagcgttactgcccaccagcctgcgtgggcggccgtggcgaggaggatggagggcgtgtcgcgctacttcagcgacaaggcctccggcagggtgctcagcgaggaggagcgcgccgccgagaacgtctacatacagaagatggagcgggagaagctggagaaactgaggaggaaggaggacaaggccaaggccgaggcggccaagagggccgccgccgccgccagaggcgacacgaagaatggtgaggaggctcatccgagctgatcatcgccaaaatcggaccagtgctcccgtgaatcgtgtgatgctgtactactgatgacacgtagatgcaaatagacgccgtcgtactactctgctttgcaactctgctcgtcgtgtcgtgtgtgatcccatccctgtcactgttgtgaacttcgcttgtagctagcgacggttttgccttgtcccttgtcggtgcaaatgtaatggagtggaggcgtccttgagcntctttcatgtacataataatgaataaatgtagtcccctcgtcgaaaacaaaaaaaaaaa

SEQ ID NO: 26 - protein, 96 aa, Zea mays
MATRRTVAASVTAHQPAWAAVARRMEGVSRYFSDKASGRVLSEEERAAENVYIQKMEREKLEKLRRKEDKAKAEAAKRAAAAARGDTKNGEEAHPS

SEQ ID NO: 27 - DNA, 2518 bp, Zea mays
tcccgccgccatcgcgtcgtgcgtgccgccgccgtcgagacgctccagggcaaggccgccaccggcgagctgctcgagaagtcggtcaacacgatccggttcctggccatcgacgccgtcgagaaggccaactccggccacccgggcctccccatgggctgcgcgcccatgggccacgtcctctacgacgaggtcatgcgctacaaccccaagaacccctactggttcaaccgcgaccgcttcgtcctctccgccggccacggctgcatgctccagtacgccctcctccacctcgccggatacgacagcgttaaggaggaggacttgaagcagttcaggcaatggggaagcagaacaccgggccaccctgagaactttgagactccaggagttgaagttaccaccgggcctcttggtcagggtatcgccaatgccgttgggttggcacttgctgagaagcacctggctgcccgcttcaacaagcctgacagtgagatcgtcgaccactacacgtacgttattttgggagatggctgccaaatggagggtattgctaatgaagcttgctccttggctggacactggggtcttggcaagctgattgctttctacgatgacaaccacatttccatcgacggagacacggagattgcattcacagaggacgtgagcacccgcttcgaggctcttgggtggcacacgatctgggttaagaatgggaacaccggatatgatgacatccgcgcagccattaaggaggcgaaggcagttactgacaagcccaccttgatcaaggtgactaccacgatcggttttggatctcccaacaaggccaactcatacagtgttcatggaagtgcactgggtgccaaagaggttgaagcaaccaggcagaaccttggatggccctatgacacattctttgtaccagaggacgtcaagagtcactggagccgccacacacccgaaggtgctgcacttgaggctgattggaacgctaagtttgcagagtacgagaagaagtatgcagatgatgcagcaaccttgaaaagtatcatcacgggggagttacccactggctgggttgatgctcttcctaaatacactccagagagcccaggagatgccaccaggaacctctcccagcagtgcctgaacgcccttgctaatgttgtgcctggtcttatcggaggcagtgctgatcttgcatcctccaacatgactctgctgaagatgtttggtgacttccagaaggatacagctgaagagcgcaatgtccgcttcggagtcagagagcacggaatgggcgccatttgcaacggcattgctctgcacagcccagggtttgttccgtactgtgctacattctttgtcttcactgattacatgagaggtgccatgaggatctcggccctgtctgaagccggagtcatctatgtcatgacccacgactctattggtctcggagaagatggcccgacccatcagcccatcgagcacctggtgagcttccgtgcgatgccgaacatactgatgctccgccctgctgatggcaacgagactgccggagcatacaaagtcgcggtcctcaacaggaagaggccgtccatcctcgctctctccaggcaaaagctccctcacctgcctggcacctcgatcgagggcgtggagaagggcgggtacaccatctctgacaactcgaccggcaacaagcctgacctcattgtgatgggcaccggctccgagctggagatcgcggccaaggccgccgacgagctgaggaaggaggggaagacggtccgcgtcgtctcgttcgtctcctgggaactctttgatgagcagtcggatgagtacaaggagagcgtcctccctgccgccgtcacagcgaggatcagcatcgaggccgggtccactctcggctggcagaagtacgtcggagcccagggcaaggccattggcatcgacaagttcggcgcgagtgctcctgccgggacgatctacaaggagtacggcatcaccgtggagagcatcattgcagctgccaagagcttttaagagctaacaacggtctggagttttttttattgtcgtcgttgatgccaaaggaacactgtacctagaggacagtcctatgcctcggagcttggaataatgatgatggagggagcggaaggatgcctgccatttgttggagcgtgcgtggtagtatttctaggcctgtaataaacaatgcctttttccatttacgttgttggttttatccggtgaccctcacacgattcatcaaggtggtgagcctggctattaaatcgggtgctgttttttttttgggtaaacattggcaatggccttactgtcttgcagcagggctttttcgtttgctggattgtgggtttaagatgctgcattttggctcttttgttgatacattttcccattggcttttgtttgtgatacatacatagcatttatatattaagctcaataagtgtgacgttttaaaaaaaaaaaaaaaaaa

SEQ ID NO: 28 - protein, 633 aa, Zea mays
MGCAPMGHVLYDEVMRYNPKNPYWFNRDRFVLSAGHGCMLQYALLHLAGYDSVKEEDLKQFRQWGSRTPGHPENFETPGVEVTTGPLGQGIANAVGLALAEKHLAARFNKPDSEIVDHYTYVILGDGCQMEGIANEACSLAGHWGLGKLIAFYDDNHISIDGDTEIAFTEDVSTRFEALGWHTIWVKNGNTGYDDIRAAIKEAKAVTDKPTLIKVTTTIGFGSPNKANSYSVHGSALGAKEVEATRQNLGWPYDTFFVPEDVKSHWSRHTPEGAALEADWNAKFAEYEKKYADDAATLKSIITGELPTGWVDALPKYTPESPGDATRNLSQQCLNALANVVPGLIGGSADLASSNMTLLKMFGDFQKDTAEERNVRFGVREHGMGAICNGIALHSPGFVPYCATFFVFTDYMRGAMRISALSEAGVIYVMTHDSIGLGEDGPTHQPIEHLVSFRAMPNILMLRPADGNETAGAYKVAVLNRKRPSILALSRQKLPHLPGTSIEGVEKGGYTISDNSTGNKPDLIVMGTGSELEIAAKAADELRKEGKTVRVVSFVSWELFDEQSDEYKESVLPAAVTARISIEAGSTLGWQKYVGAQGKAIGIDKFGASAPAGTIYKEYGITVESIIAAAKSF

SEQ ID NO: 29 - DNA, 687 bp, Zea mays
  misc_feature 678: n = A,T,C or G
tagctgctaatagctgtagctgtacttgtgtagccgagagactccattatattatattgctcgatctctccatctgaacgtacacacagtccaacacacatggccgccgccgccgccgccctggtgagcagcaacagcctccgcgccccggcggccttctccgtcgtcgtccgcgcggcctcccggccggcgcctgtcgtcgcagtagtgacgccgctgcccgcggccaaggcggccgccgcccgcggcgccaggctgcgcgcgcaggccacccacaacgtcaagctcatcacgccggacggggaggtacagctcaagatgcccggcgacgtctacatcctggaccatgccgaggaacgagggttggacctgccctactcctgccgcgccggcgcctgctcctcctgcgtcggcaagatcgtctccggctccgtcaaccagttcgaccagagcttcctcgacgacgaccaggtcgccgagggctttgtgctcacctgcatcgcctaccccacctcggacctcgtcatccagacgcacaaggaggatgcactcgtcgagtcgtactagtatagtcagcaattaatgcaccacgtacgcacgctctccttgcattgcatgcatgtaataataataataacgacgccgccatgtaataataactaactatacatggtcctnaaaaaaaaa

SEQ ID NO: 30 - protein, 155 aa, Zea mays
MAAAAAALVSSNSLRAPAAFSVVVRAASRPAPVVAVVTPLPAAKAAAARGARLRAQATHNVKLITPDGEVQLKMPGDVYILDHAEERGLDLPYSCRAGACSSCVGKIVSGSVNQFDQSFLDDDQVAEGFVLTCIAYPTSDLVIQTHKEDALVESY

SEQ ID NO: 31 - DNA, 1377 bp, Zea mays
gtaactccgcatcgatcaccctcctcgctcccggtcaacagcagcggcgcagagcacgacaccgacacgcgccatggcggcggtgaggcaccggcagctggaggccaacggcatcacgatgcacgtcgcggaggccggccccgtgaacgcctccgcgccggcggtgctgttcgtgcacggcttcccggagctctggtactcgtggcgccaccagatgggctacctcgccgcgcgcggctaccgctgcgtggcacccgacctccgaggctacggcggcaccaccgcgccgccggaaccgaactcctacaccgtcttccatatcgtcggcgacatcgtcgcgctcctcgacgccctccacctcccgcaggtgttcgttgtcggccacgactggggcgccatcgtgtcgtggaacctctgcctgctgcggccggatcgggtgcgcgcgctcgtcaacctcagcgttgccttcatgccccggaggcccggcgtcaagcctcttgagtacttccgcgccgcatacggggatgagtactacgtctgccgattccaggaaccaggactcgaagcagaatttgctacgtttgacttgaagagtttcttcacattggcattgactcttcgggcaacaggttcttcagctatggaccttcgaaaaatgcaaacttacagtaagcaaatggtgctaccttcttggctatctgaggaagatgtcagttaccttgcaagtgtgtactcaaaaactggatttgctggtggagtaaattactatcgctgcttggacctgaactgggaactgatggcgccatggacaggagcaaaggtgcaagttccaaccaagttcatcgttggggacggtgacctggcgtaccatcaccctggagtgaagaggtacatccacaagggcgggttcaagagggacgtgcccatgcttgaggaggtggtggtcatcaagggcgctgggcacttcatccagcaggaaagagcgcaggaaatcagtgagcacatccatgactacatcaagaagttcgaagcttgtggtctgccgccactgagagtttcaaagctgtgagagacctgatggcttctgtacataactcaaatggtctgggagctattgtagttgtttgtagtgctgcagatctatatattatgaatggtatgaagtactgacgatctattcaagggacccacgttgcgttgtgctgtgtggggggcactggtccccacttaattttcttgtttcagtggacatcttattttatttgatgtagctacaaaggttcattagggcatgtacaatccaaaaaataatttgtatcatatgaaatctaagagggtaagtgaaaaaacaaaaaaaaaaaaaaaaaaaaaaaaaaa

SEQ ID NO: 32 - protein, 331 aa, Zea mays
MAAVRHRQLEANGITMHVAEAGPVNASAPAVLFVHGFPELWYSWRHQMGYLAARGYRCVAPDLRGYGGTTAPPEPNSYTVFHIVGDIVALLDALHLPQVFVVGHDWGAIVSWNLCLLRPDRVRALVNLSVAFMPRRPGVKPLEYFRAAYGDEYYVCRFQEPGLEAEFATFDLKSFFTLALTLRATGSSAMDLRKMQTYSKQMVLPSWLSEEDVSYLASVYSKTGFAGGVNYYRCLDLNWELMAPWTGAKVQVPTKFIVGDGDLAYHHPGVKRYIHKGGFKRDVPMLEEVVVIKGAGHFIQQERAQEISEHIHDYIKKFEACGLPPLRVSKL

SEQ ID NO: 33 - DNA, 1885 bp, Zea mays
gggaaaaggaaacggaaaaactcccagttcgtgacggacacgagccgaggccagcgccatccacccgctcccctccgcgcccggccgcaccgctcccctccgctcggccttcatctccccacagccgcaagcgacgggcgtcatatcccatcctgatctctcctcccttcttcagtgcagcagcaggccagcggcacgccacccgcctcactcccgcctccgatccgctgcttactcgccacccggagatggccaccgccgccgccttctctgtctcctcgccggcggcctccgccgtcgccgcgcgatccaaggtgtttggaggagttaaccaggcgagaactagaactggctgccgcgtcggcatcacgcggaagaactttggccgtgtcatgatggcccttgcagtggatgtttctcgttttgaaggagtgccaatggctcctccagacccaattcttggggtttctgaggcctttaaagcagataaaagcgagctgaagctcaatcttggtgttggtgcctataggacagaagagctgcagccctacgtgctcaatgtagtcaagaaggctgaaaatcttatgttggagaaaggagaaaacaaagagtatcttcccattgaaggtttagccgcgtttaacaaagcaacagcagagctattgcttggagctgataaccctgttattaatcaaggactggttgctacacttcagtctctctcgggcactggatcactgcgtctcgctgcagcattcatacaaagatactttcctgaagctaaagtgctgatatcgtcgcctacctggggtaaccacaagaatatcttcaatgatgctagggtaccttggtcagagtaccggtattatgaccccaagactgttgggttggattttgagggaatgatagctgacattgaggctgctcctgaaggatcttttgttctgctacatggttgtgctcacaacccaactggaatagacccaactcctgaacagtgggagaaaattgcagatgtcattcaagagaaaaagcatatgccattctttgatgttgcatatcagggttttgccagtggaagccttgatgaagatgcattttctgtcaggctttttgttaagcgtggcatggaagtgtttgttgcacaatcttacagcaagaaccttggtttatattctgaaagggttggtgcaataaatgtcgtgtgctcagcaccagaagttgcagatagggtaaagagccagctgaaacgattggcacgtcccatgtactcgaacccccctattcacggtgccaagatagttgccaacgttgttggtgatccaaccatgtttggtgaatggaaacaagagatggagctaatggctggacggatcaagaatgtaagacagaagctctacgacagtttgtctgccaaggacaagagcggcaaggactggtctttcattctgaggcagattggcatgttctcctacaccggcttgaacaaagcgcagagtgacaacatgacggataaatggcatatttacatgaccaaggatgggcggatctcgttagctgggctgtccctggctaagtgtgattatcttgccgacgccatcatcgattccttccataatgtgaactaggctgaggtacgatagttgagggtcaagctattgatgtttagttccgtggacgctaggctgggatttttgggtccttccagctatacagctcttccgttgtgctccatctggtgtaacttggataaataaaaattttgtcgctgaactaaaactcgtgtgcttttttacctgtaactgtaaggtcagcgcgtggctacagacttgtaaacacttgaatggaaaaaaaacaatgacattaccgaaaaaaaaaaaaaaaa

SEQ ID NO: 34 - protein, 459 aa, Zea mays
MATAAAFSVSSPAASAVAARSKVFGGVNQARTRTGCRVGITRKNFGRVMMALAVDVSRFEGVPMAPPDPILGVSEAFKADKSELKLNLGVGAYRTEELQPYVLNVVKKAENLMLEKGENKEYLPIEGLAAFNKATAELLLGADNPVINQGLVATLQSLSGTGSLRLAAAFIQRYFPEAKVLISSPTWGNHKNIFNDARVPWSEYRYYDPKTVGLDFEGMIADIEAAPEGSFVLLHGCAHNPTGIDPTPEQWEKIADVIQEKKHMPFFDVAYQGFASGSLDEDAFSVRLFVKRGMEVFVAQSYSKNLGLYSERVGAINVVCSAPEVADRVKSQLKRLARPMYSNPPIHGAKIVANVVGDPTMFGEWKQEMELMAGRIKNVRQKLYDSLSAKDKSGKDWSFILRQIGMFSYTGLNKAQSDNMTDKWHIYMTKDGRISLAGLSLAKCDYLADAIIDSFHNVN

SEQ ID NO: 35 - DNA, 1698 bp, Zea mays
ggcgtacgcggcgaggcggaagaagcgggtgggccgctacgaggtgggccggaccatcggccagggcaccttcgccaaggtcaagttcgccgtcgacgccgacaccggcgcgcccgtcgccatgaaggtgctcgacaaggagaccatcttcgcccaccgcatgctccaccagatcaaaagggaaatatcaatcatgaagatcgtaagacatcccaacatagtcaggcttaatgaggtgttggcagggaagacgaagatatacataatcttggaacttgtcaatggaggcgaactgtttgataaaatagcccgatatgggaagctacgtgagaatgaagccaggaagtatttccagcagcttattgatgccattgattattgccacagcaaaggagtttatcatagggatttgaagcctgaaaatatgcttcttgactcacgtggaaacttaaaagtttctgattttggacttagtacactgtctcagaatggagcaggacttcttcacacaacatgtggaacaccaaattatgttgctcctgaggtgctaggtagcgatggatatgacggacctgcagcagacatttggtcatgtggtgtcattctctatgttttaatggctggttaccttccctttgaggagaatgaccttccaagtttgtatgaaaagataactgcagctaagtactcatgcccatactggttctctccaggagccaagtcattgatccagagattacttgatccaaatccaagaactcgtatcactattggagaaataagagcagacccatggtttgagaagaactatgtagctattagacgcggtgaagatgagaatgttagcctggatgatgttcaagctgtttttgacaatattgaggacaagtacgtatctgaggaagtaactcacaaggatggtggtcctcttatgatgaatgcctttgagatgattacgctatctcaaggtttggatctctcagcgttgtttgataggcaacaggagtatgtcaagcgccaaacgcgttttgtctcaagaaaaccagctaagactatagtagctacaattgaagttgttgccgagtcaatgagtctcaaggtccactcccagaattacaagctgcggcttgaaggtgcatcatcgaacagaacgagccaattcgctgttgttctagaggtttttcaagttgccccttctctgttcatggttgatgttcgaaaggtcgccggtgacaccctggaataccacaggttttacaagaacctatgcagcagacttgacagcataatctggaggccaatcgaagtttctgcgaaatctaagctgctgaggacgaccacttgctagcccagcactgagctactgtaaatggcaaccaacaacaagagacgtggttcgtagccgttagaagagggggaaacttctgttaaatccagcgtatagctcgtggagctgggattcacgaggatttctgcatctcgctttctcaggtgatgcatgtaccatagctgtcttcgttagatcagacgaggcagctcaaagcaccaggtgtttgtatatatatattttttgtaacgctattgtagatagcctgtgtagctccagccgtgcagctgtatgtagcagaaacctgaatgtccgaaaacgcccctgaatgtcaggtagaatcgttgcttgaaaaaaaaaaaaaaaaaaaa

SEQ ID NO: 36 - protein, 408 aa, Zea mays
MKVLDKETIFAHRMLHQIKREISIMKIVRHPNIVRLNEVLAGKTKIYIILELVNGGELFDKIARYGKLRENEARKYFQQLIDAIDYCHSKGVYHRDLKPENMLLDSRGNLKVSDFGLSTLSQNGAGLLHTTCGTPNYVAPEVLGSDGYDGPAADIWSCGVILYVLMAGYLPFEENDLPSLYEKITAAKYSCPYWFSPGAKSLIQRLLDPNPRTRITIGEIRADPWFEKNYVAIRRGEDENVSLDDVQAVFDNIEDKYVSEEVTHKDGGPLMMNAFEMITLSQGLDLSALFDRQQEYVKRQTRFVSRKPAKTIVATIEVVAESMSLKVHSQNYKLRLEGASSNRTSQFAVVLEVFQVAPSLFMVDVRKVAGDTLEYHRFYKNLCSRLDSIIWRPIEVSAKSKLLRTTTC

SEQ ID NO: 37 - DNA, 1395 bp, Zea mays
ggcaccgggtgacacacaggcacaaagacaccgcccgtacacaggctcgttggcttggctgctgtgtgttgcgctcagccattcagacttgagagctactagctaactgctcgttgggtgtgggtgcgctcccggcctagaccgtggaggaaaggagtccagtccactcactaccccctctgctccgttcgggttccaggccagcacagccgagggttccgcacagcgataagcgcgaagcggaagagatggagcatatcgccaggttcttcttcggagtttctgggaatgtcattgcgctcttcctcttcctgtcgcctgttgtcaccttctggagggtcatcaggaagcggtcgacggaggacttctccggcgtgccctacaacatgacgctgctcaactgcctcctatcggcttggtacggcctgccgttcgtgtccccgaacaacatcctggtgtcgacgatcaacgggacggggtcggtgatcgaggccatctacgtggtgatcttcctcatcttcgcggtggaccggcgggccaggctcagcatgctgggcctcctgggcatcgtcgcctccatcttcaccaccgtggtgctcgtctcgctgctggccctccacggcaacgcccgcaaggtcttctgcggcctcgccgccaccatcttctccatctgcatgtacgcctcgccgctctccatcatgaggctggtgatcaagacgaagagcgtggagttcatgccgttcctgctctccctggccgtgttcctgtgcggcacctcctggttcatctacggcctcctcggccgcgaccccttcattattatcccgaacgggtgcgggagcttcctgggcctgatgcagctcatcctgtacgccatctaccggaaaaacaagggccccgccgcgccggccggcaagggagaggccgccgccgccgccgcggaggtggaggacaccaagaaggtggccgctgccgtggagctggccgatgccacgaccaacaaggcagcggacgccgtcggcggcgacggcaaggtcgccagccaggtgtaggcgggcaaggcttatttgctgtctgggactgggaggaacatcctaaacgaggctgccttagtttgtcggtggagcagattggtgttggtttctgtgggcttttacggttgttgttactctcatctccatctctcccaggaggctaccccaagcatgtagtagcttccattctgattctgggacggtgttgcacgttacagtgctctcaagctgtctctgcaaagtgtgtttttttattccatttccctcctgctcttgttctccaactgcgcttacctgcccccgatttctctaaaaaatgtattaaactatctgagaaattcatccaaaaaaaaaaaaaaaa

SEQ ID NO: 38 - protein, 267 aa, Zea mays
MEHIARFFFGVSGNVIALFLFLSPVVTFWRVIRKRSTEDFSGVPYNMTLLNCLLSAWYGLPFVSPNNILVSTINGTGSVIEAIYVVIFLIFAVDRRARLSMLGLLGIVASIFTTVVLVSLLALHGNARKVFCGLAATIFSICMYASPLSIMRLVIKTKSVEFMPFLLSLAVFLCGTSWFIYGLLGRDPFIIIPNGCGSFLGLMQLILYAIYRKNKGPAAPAGKGEAAAAAAEVEDTKKVAAAVELADATTNKAADAVGGDGKVASQV

SEQ ID NO: 39 - DNA, 1054 bp, Zea mays
ggaccccgcacgtgatcccgatcgcgccccctttaccccaaccgccagttcaggatcggacgaaccgtgaggcggccacgtccaccccaccatacgtctggcgccgtgcacggtgcacgcacctgtcgacgggctcccatcgaactcgaaccctctctacgccgactcggctcttctcccccaacacaatcctccttccccgatccagtctcgcggtcgcggccacgctgagggagagcgagaagagacagacacagatcgcgcgcggagatgtcgtcggactcgtcgtcgtgggcgcgcgccctggtgcagatctcgccctacaccttctccgcaatcggtatcgccgtctccatcggcgtctccgtcctcggcgcggcatggggtatcttcatcacggggagcagcctcatcggggccgccatcaaggcgcccaggatcacttctaagaacctcatcagtgtcatcttctgtgaggctgtcgcaatttatggcgtaattgtggcaatcatcctccagacaaagcttgaaagtgtgccaacatctcaaatgtatgatccggagtctcttcgagctggctatgcaatctttgcatctggccttatcgttggctttgctaatcttgtttgcggggtatgcgtggggataattggaagcagctgcgcactgtctgatgctcagaactcatcactcttcgtaaagattttggtgattgagatcttcggcagcgctctgggactgttcggtgtcattgtgggcatcattatgtcatctcaagcgacatggccagcaaaagcttgattttcaccatttgtagctctgtaaattattcagatggagtgtatcgaaatgtgcatgtggtctaactgcattttcatgttccttttatgtggcgtcttttttggcagaacacgaaatgcggcgcgcgtaccgccaccgattgtagagttgctattcttactgccggagtactccatgtgtgttggatatcttgttggcatattaaataaatgcttggacaaaataaaatgattttttgccaaaaaaaaaaaaa

SEQ ID NO: 40 - protein, 176 aa, Zea mays
MSSDSSSWARALVQISPYTFSAIGIAVSIGVSVLGAAWGIFITGSSLIGAAIKAPRITSKNLISVIFCEAVAIYGVIVAIILQTKLESVPTSQMYDPESLRAGYAIFASGLIVGFANLVCGVCVGIIGSSCALSDAQNSSLFVKILVIEIFGSALGLFGVIVGIIMSSQATWPAKA

SEQ ID NO: 41 - DNA, 1165 bp, Zea mays
gctcttccgtcctcccgttcccgtcccgcacacagactctttctctctcctcccctctctcgtcctctctctctcgtccgatctgcatctgcttttctcccccttgtctgtctctctcctgtccgtggcgtgcgcaaagatttgattttttttttctcggggaggagccggagtccgagcaggagtggcggcgggagggaggagatcctgatctgttgtcgcagcggggaggggaggaccggaggaggaagatggctgcgcaggagcaggagcaggagcaggagaagcagcaggcgaagacgagcaccacgagctcgctcccctccagcagcgagcgctcctccagctccgctcgcaacaacctcacggaaggaggggcggagagcgacgaggagatacggcgggtgccggagatgggcggcgcgtcggcgtcggcctcgtcgggcgccggcgcggacgagcgtcccaagggggaggacggcaagcaggggcaggtggcggcgggggcgcagcctccggcgggcgggaagaagcgcgggcgcacggcgggggacaaggagcagaaccggctgaagcggctgctgcggaaccgcgtgtccgcgcagcaggcgcgggagcggaagaaggcgtacctgacggagctggaggcgaaggccaagggcctggagctccgcaatgcggagctggagcagcgggtgtccacgctccagaacgagaacaacacgctccgccagattctgaagaacacgacggcgcacgcgagcaagaggtccggcggcggcgccggcggcaagggcggagacggcggcaagaagcaccacctcgccaagagctagtgagaaatgagagagggagctggttcgtgccctgctcgcgctcgcctgatctgaccattgctggcgtgttgctgttcctgacgacgccttctctttttcttcttttctcctactgttacccgtgggtttcgtctcttgcctcgctgatgcactgttttaactgttagccatcccgtctactcaccagtgaacactgctgctagttaatttctcggtggtttagggtgccgtgccagaacgccgtgaacttcgttcttgtactgtcctgtagtccagccttgcggtttggcaattcgattcaagattactgtaaaaaaaaaaaaaaaaaa

SEQ ID NO: 42 - protein, 194 aa, Zea mays
MAAQEQEQEQEKQQAKTSTTSSLPSSSERSSSSARNNLTEGGAESDEEIRRVPEMGGASASASSGAGADERPKGEDGKQGQVAAGAQPPAGGKKRGRTAGDKEQNRLKRLLRNRVSAQQARERKKAYLTELEAKAKGLELRNAELEQRVSTLQNENNTLRQILKNTTAHASKRSGGGAGGKGGDGGKKHHLAKS

SEQ ID NO: 43 - DNA, 1889 bp, Zea mays
gctcgcgttttaaactattccctgatccaacccctcctcaaactctgacgacgcctccttccgtgcccgtccgtcctctataagggcgccgccgaggagagagaacgatgacttcagctctccggcggaaggcggcgcagatggcttccgcggcgacacagtgcttcagctactcctcgttgccggccacgtgggctctgcggcagcggggcggcggtgccagcgtgctccggctctcttcccggcggaccttctcggtctccgcggcggccgggttcgacaaccagaaccgcgagtatgtgatcgtcgggggagggaacgctgcgggttacgccgccaggacgttcgtcgagcatggcatggctgacggccgcctttgcatcgtctccaaggagccagttccaccatacgagcggccagccttgaccaaaggctatctttttcctccggacaagaaaccggctcgcctacctggtttccatacatgcgttggatctggtggacagcgacagactgctgaatggtacaaggagaatggtatagaggtgctgtatgaggatccagttgtagcatttgatggcaaaacgcaaaccttaaagacttcatcggggaaagttctgaaatacggctcacttattatttctactggatgtgaagcatcgagattacctgagaaaattggagggaaattacctggagttcactacatacgggatgttgctgatgctgatgctctagtatcctcattgggaagtgcaaagaaggtggtggttattggtgggggctatattggcatggaggtagctgcagcagcttgtggctggaatcttgacacaactattatattcccagaggaccacattatgccaagattatttacaccctcgcttgctaagaagtatgaggaactgtatcagcaaaatggtgtcaaattcataaagggagctcttatcgaaaaacttggagctggctctgatggaagggtgtcttctgcagtacttaaggatggatctgtagttgaagctgatacagtaattgttggtataggagcaaaaccagttgtcagcccgtttgaagctgttggagttaaccctaaagttggtggaatagaggttgattccttgttcagaactagtgtacctggcatctttgcaattggagatgtagcagcgttccccctgaagatgtacaatagaattgctcgagtggaacatgtggatcatgctcggaagtctgcgcaccactgtgtagagacgctcctaacatcccagacaaaagcgtatgactaccttccatacttctactcgagggtttttgagtacgagggaagttcgaggaaagtctggtggcagttttatggcgacaatgtcggcgaagcagtcgaagtagggaactttgatccaaaggttgcgactttctggatcgactctgatagccggctgaagggtgttttcctcgagagtggaacctcagaggaattctcgcttcttccgcagctcgccaaatctcagcctgttgttgacaagtcaaagctccaggccgcgacttctgttgaagatgcattagagattgcaagaagctcactccggtccagtgccatggtttagctctcagaatctagtactttcttgaacccgaggctgtgcgctgctcgagcggttcatagcgtcgagaccacgtcagcaataacgcacaattacatagaatctattcccactggggttgtaacattcttcagtgcacctgcgtcggctatttccagcttgaaataaacctggttgccctttgaggggttgatgaggatgatagattgaagcctttttgtttaaaaaaaaaaaaaaaaaaaaaaaaaaaaaaaaaaaaaaaaaaaaaaaaaaaaaaaaaaaaaa

SEQ ID NO: 44 - protein, 499 aa, Zea mays
MTSALRRKAAQMASAATQCFSYSSLPATWALRQRGGGASVLRLSSRRTFSVSAAAGFDNQNREYVIVGGGNAAGYAARTFVEHGMADGRLCIVSKEPVPPYERPALTKGYLFPPDKKPARLPGFHTCVGSGGQRQTAEWYKENGIEVLYEDPVVAFDGKTQTLKTSSGKVLKYGSLIISTGCEASRLPEKIGGKLPGVHYIRDVADADALVSSLGSAKKVVVIGGGYIGMEVAAAACGWNLDTTIIFPEDHIMPRLFTPSLAKKYEELYQQNGVKFIKGALIEKLGAGSDGRVSSAVLKDGSVVEADTVIVGIGAKPVVSPFEAVGVNPKVGGIEVDSLFRTSVPGIFAIGDVAAFPLKMYNRIARVEHVDHARKSAHHCVETLLTSQTKAYDYLPYFYSRVFEYEGSSRKVWWQFYGDNVGEAVEVGNFDPKVATFWIDSDSRLKGVFLESGTSEEFSLLPQLAKSQPVVDKSKLQAATSVEDALEIARSSLRSSAMV

SEQ ID NO: 45 - DNA, 1580 bp, Zea mays
gcgaaattcatccaaaagaaactcctgataaatataaaaaggaggggaaaaagaaaaacacttgcagcggcatccaccaccggagctcccatcatcggtctatccctccgtgtcaaccccctcctcagaagttctaattgcagttcagcccctggccggtccgccgggccaccggaaggagccgctcgccggaggaagccccccatctccttgccctgcggcgggtttatggggttctcgctgtaccccatgaagacgtccacgcggttgctctggagcactagcttcttccgccataagctcagctcctcctcctgcttcctctgagcccgccccacccgcgtcgatcacctcggcggcggcccgctgttgctgcgcggtcctagcacccgttcgagtgtgtgtgtttgtgttctttgagtttcaagattgggttttgttgcgttattggggagacgaagggactaaggcgcagtgagcggacaagaatcagcatggatccgagcgcggtcagtttcgactctggcggcacgcggcggggcggcggcgcgcagatgctgctcttcggcggcggaggcagcgccaacagcaacggcttcttccgaggtgttccgatggcggtcctgggcatggacgacgcgacgcgcgtgggcaagcggcccttcttcacgacacacgaggagctcctagaggaggagtactacgacgagcaggcgccggagaagaagcgccgactgacggcggagcaggtgcagctgctggagcggagcttcgaagaagagaacaagctggagccggagcgcaagaccgagctggctcgccgcctggggatggcgccccgccaggtagctgtttggttccagaaccgccgcgcgcgctggaagaccaagcaactcgagaccgactatgaccgcctcaaggctgcttacgacgcactcgccgccgaccaccagggcctcctggccgacaacgataacctccgggcacaggtgatctccctgacggagaagctgcaaggcaaggagacatacccgtcggcaaccactgctgcccaagaggtcgaccagccagacgaacacaccgctgtgtcaggcacggaagaactgctggcgcagcagctcaaggacaacctccacagcagcggcgactgcactggccatggcaccctctcttcggaagaagacgacggtggcgtggtcagtgacgagggctgcagcttcgctctcccggatgccatgttcgctgccgggttcacccaccatggcgccgaggaggtgcagctggccaactggacatccatgttctggaactgatcagcggatggatgcatccaagtgcaaagatcggatcctctcctcgtctcgacccttttctgcagcatataattaccgtgttaattatgtgccgtccgatgtttttaagtgctcatgttttaagtttgtgtttttttgaagattttgtatgttcatatatataataatgtgcttcgaacatgacactcgaaaagttgaataattggacatgtcgacctgctgtgcactagcagctggcatgttttgtttaaaaaaaaaaaaaaaaaa

SEQ ID NO: 46 - protein, 272 aa, Zea mays
MDPSAVSFDSGGTRRGGGAQMLLFGGGGSANSNGFFRGVPMAVLGMDDATRVGKRPFFTTHEELLEEEYYDEQAPEKKRRLTAEQVQLLERSFEEENKLEPERKTELARRLGMAPRQVAVWFQNRRARWKTKQLETDYDRLKAAYDALAADHQGLLADNDNLRAQVISLTEKLQGKETYPSATTAAQEVDQPDEHTAVSGTEELLAQQLKDNLHSSGDCTGHGTLSSEEDDGGVVSDEGCSFALPDAMFAAGFTHHGAEEVQLANWTSMFWN

SEQ ID NO: 47 - DNA, 2011 bp, Zea mays
gcaccagccaagtcctgtcaaggcctcaacacacacacacactctctcgcttgacctacccccctccgccccccgccgggcctgcagggtgttcgacgcttcgcccgcccgcccgagcgccgccacggcatggcttcctccatctccgccgccgctaaggcctccgcggcctttgcccaaaagaaggagctggccgcgccggcgccgcaccgcgcgggctcgagccgtcggaccaagccgtgccgcgtgcgcgccgtcgcgtcgcccgcgcgcagcccccgcgccccgtcgtccaccggctcggtgaagaccgcgatgacgatgacggagaagatcctggcgagggcgtcggagcgcgcggcgctggagcccggggagaacgtgtgggtggacatcgacgtgctcatgacgcacgacgtctgcgggcccggcaccatcggcatcttcaagaaggagttcggggaggatgccaaggtctgggaccgcgagaaggtcgtcatcatccccgaccactacatcttcaccagcgacgagcgagccaaccgcaacgtcgatatcctcagggacttctgtctggagcagaacatcaagtacttctatgatatcaaggacctcagcgatttcagggctaatccagactacaagggtgtctgccacattgcgcttgctcaggaaggccactgccgaccaggcgaggttctcctgggtactgattctcatacgtgcaatgctggagcctttggtcaatttgcaaccggaatcggaaacactgatgcaggttttgtgttgggcactggaaaggctcttctcaaggtgccacctactatcaggtttgtattagatggagaaatgccaccttatttacttgcgaaggatctgattttgcaaattattggtgagatttcagtatctggtgcaacctacaaatcgatggagtttgttggatcaactgtagaaagtctaactatggaagaacgtatgacactatgcaacatggttgttgaagctggtggaaagaacggtgtcgtgcctgctgatgaaactacatttaaataccttgagggtaggacatcagttgattatgaacctgtctacagtgatgctgaggccagattttttagtgactaccggtttgatgtatcgaaactggagccagtagttgccaagccacattcgcctgacaaccgtgccctagcaagagaatgcaaagatgtcaagatcgaccgagtctatattggttcctgcactggtggcaagactgaggacttccttgctgccgcaaaggtgttcttagcctcgggaaagaaggttaaagttcccacattccttgtccctgccacacaaaaggtgtggatggacgtatatagccttcctgtaccaggatctggtggcaaaacttgcgcccagatattcgaggaggctggttgtgatacaccagcaagtcctaattgcggcgcttgtttgggtggccctcgcgatacgtatgcacggatgaatgaacctacggtctgcgtgtccaccacgaacaggaacttcccgggcaggatggggcacaaggaagggcagatctacctggcgtccccctacaccgctgccgcctcggccctgacggggtacgtcacggaccccagggacttcctcatgtgaacgatcttgaaagagccacagagtgcctgcactgctgtttttcatgttgaaccttagtttaggcgtgtgcccttcgttgagaaataactcccatgtcgggaggctgccattgccatgtatgttttttgcgttatatttattacagtgactgccgataacgtagttgagcgttacaagggaaatacattcattcttcccagtatcgaattatcgatggcagtcactagacaccgttcttacaaaaaaaaggcatgttgagagatcttgtagttcatacacttgttaaaacattttttgtacaatgtatgggaaagaagctcagtcgaaaaaaaaaaaaaaaaaaaaaaaaaaaaaaaaaaaaaaa

SEQ ID NO: 48 - protein, 505 aa, Zea mays
MASSISAAAKASAAFAQKKELAAPAPHRAGSSRRTKPCRVRAVASPARSPRAPSSTGSVKTAMTMTEKILARASERAALEPGENVWVDIDVLMTHDVCGPGTIGIFKKEFGEDAKVWDREKVVIIPDHYIFTSDERANRNVDILRDFCLEQNIKYFYDIKDLSDFRANPDYKGVCHIALAQEGHCRPGEVLLGTDSHTCNAGAFGQFATGIGNTDAGFVLGTGKALLKVPPTIRFVLDGEMPPYLLAKDLILQIIGEISVSGATYKSMEFVGSTVESLTMEERMTLCNMVVEAGGKNGVVPADETTFKYLEGRTSVDYEPVYSDAEARFFSDYRFDVSKLEPVVAKPHSPDNRALARECKDVKIDRVYIGSCTGGKTEDFLAAAKVFLASGKKVKVPTFLVPATQKVWMDVYSLPVPGSGGKTCAQIFEEAGCDTPASPNCGACLGGPRDTYARMNEPTVCVSTTNRNFPGRMGHKEGQIYLASPYTAAASALTGYVTDPRDFLM

SEQ ID NO: 49 - DNA, 952 bp, Zea mays
gcacagacagtcacagacacatccaacgagcccgaccgccagagctcgccgccgtcctccgcagacaatccaccatggcgatggtgctggggatggtgctggggaagatcccggtggagacgcccaagcacgaggtcctccacaccggcgccggctacgagatccgcaagtacccgcccagcatcgccgcggagttgacctacgatcccaaggagatgagaggagaccctgatggcgggttcaccgtcctcgccaactacatcggggtcctcggaaagccgcagaacaccaagcccgagaagatcgccatgacggctcccgtcatcaccaccggcagcggcagcggcggcgacggcgagaagatcgccatgacggcccccgtcatcaccaccggcggcggcgagcccgagcccatcgcgatgaccgcgccggtgattacggacgaccagcaggcgccgggcaaggtgacaatgcagttcctgctgccgtccaagtacaccagggtggaggaggcgccgcggccgacggacgagcgggtggtgatccgcgaggtgccggagaggaagttcggcgtggcgaggttcagcggggtggccacggacaggacggtgagggagaaggcgaagggacttaaggccgccctggagaaggacgggtacaccatcaaggtcccgttcgtgctggcgcggtacaacccgtcgttcacgctcccgccgctgcgcaccaacgaggtcatgttccccgtcgagtgatccggcaaggcgccggccaccgcccagctaccggccgcggttcttctgtgaaatgacggcttgaggttcaggaggaactgtgtttgtattttgtatctgtatttctcttgaagttgttgtagaatatgctttatgcaacgagttatggataaattttactactcttcgatcaatgaagaactaaaaaaaaaaaaaaaaaa

SEQ ID NO: 50 - protein, 225 aa, Zea mays
MAMVLGMVLGKIPVETPKHEVLHTGAGYEIRKYPPSIAAELTYDPKEMRGDPDGGFTVLANYIGVLGKPQNTKPEKIAMTAPVITTGSGSGGDGEKIAMTAPVITTGGGEPEPIAMTAPVITDDQQAPGKVTMQFLLPSKYTRVEEAPRPTDERVVIREVPERKFGVARFSGVATDRTVREKAKGLKAALEKDGYTIKVPFVLARYNPSFTLPPLRTNEVMFPVE

SEQ ID NO: 51 - DNA, 1889 bp, Zea mays
gcaacgcaagcactccacactgctgtgcagaacgagagccacaccatcagtagttagagcgaccaatagatgagttcctccccgtcctttggtctcctggctgtagcagcattactcctagcactgagcttagcacaacatggctccctcgccgcaaccgtcggccccagggtcatcgtcgtcggcgccggcatgtctgggatctcggcggcgaagaggctgtcggaggccgggataaccgacctgctgattctggaagcgacggaccacatcggcgggcggatgcacaagacgaacttcgccggcatcaacgtcgagttaggcgccaactgggtggagggcgtgaacggcggcaagatgaaccccatctggcccatcgtcaactccaccctcaagctccgcaacttccgctccgacttcgactacctcgctcagaacgtctacaaggaggacggtggcgtctacgatgaagattacgtccagaagagaattgaactggcggacagcgtggaagagatgggggagaagctctctgccactttgcacgccagtggcagagacgacatgtctatccttgccatgcagcgcctcaacgaacaccagccgaacgggccggcgacgccggtggacatggtggtggactactacaagttcgactacgagttcgcggagccgccgcgcgtgaccagcctgcagaacaccgtgcctctcgcgaccttcagcgacttcggcgacgacgtctacttcgtcgccgaccagcggggctacgaggccgtcgtctactacctcgccggccagtacctcaagaccgacgataagtctggaaagatcgtcgacccgcgcctgcagctcaacaaggtggtgcgagagatcaagtattccccgggtggcgtcaccgtcaagacagaggacaactcggtgtacagcgcagactacgtcatggtttctgcgagcctgggtgtcctgcaatccgatctcattcagttcaagcccaagctacctacatggaaggttagggcgatctaccaattcgacatggccgtgtacaccaagatcttcctcaagttccccaggaagttctggcctgaagggaaaggaagggagttcttcctctacgccagcagcaggagaggttactacggagtgtggcaggagttcgagaagcagtaccctgacgccaatgtcctcctggtcaccgtgaccgacgaggagtcgaggcgcatcgagcagcagtcggacgagcagaccaaggcggagatcatgcaggtgctgcggaagatgttccccggcaaggacgtcccggacgccaccgacatccttgtcccgaggtggtggtccgacaggttctacaagggcaccttctccaactggccagttggcgtcaaccgctacgaatacgaccagcttagggcaccggttgggagggtatacttcaccggcgagcacaccagcgagcactacaatggctatgtccatggagcctatctttcaggtatcgactccgctgaaattctcatcaactgcgcccagaaaaagatgtgcaagtaccatgtccagggaaagtatgactaggaagctacagcaaattgatttaaagctccagcaaattgagcagtgtggatgttgcatttctcagttcattttttccctgttttcaacaaagtatagatgacagccatgttccctcgcggcatatgccttttcattattccaataaagctagcggctggttcgatgagcacgatttgtgatcgagtatcctgtttaataagtacggtgtttgctttttttttcatgatgaggggtgcatggcttatgatattctatctatttgctaatcaaaactttgtaccatgggaaaaaaaaaaaaaaaaaaaaaaaaaaaaaaa

SEQ ID NO: 52 - protein, 500 aa, Zea mays
MSSSPSFGLLAVAALLLALSLAQHGSLAATVGPRVIVVGAGMSGISAAKRLSEAGITDLLILEATDHIGGRMHKTNFAGINVELGANWVEGVNGGKMNPIWPIVNSTLKLRNFRSDFDYLAQNVYKEDGGVYDEDYVQKRIELADSVEEMGEKLSATLHASGRDDMSILAMQRLNEHQPNGPATPVDMVVDYYKFDYEFAEPPRVTSLQNTVPLATFSDFGDDVYFVADQRGYEAVVYYLAGQYLKTDDKSGKIVDPRLQLNKVVREIKYSPGGVTVKTEDNSVYSADYVMVSASLGVLQSDLIQFKPKLPTWKVRAIYQFDMAVYTKIFLKFPRKFWPEGKGREFFLYASSRRGYYGVWQEFEKQYPDANVLLVTVTDEESRRIEQQSDEQTKAEIMQVLRKMFPGKDVPDATDILVPRWWSDRFYKGTFSNWPVGVNRYEYDQLRAPVGRVYFTGEHTSEHYNGYVHGAYLSGIDSAEILINCAQKKMCKYHVQGKYD

SEQ ID NO: 53 - DNA, 1315 bp, Zea mays
  misc_feature 22: n = A,T,C or G
gagagacagagagagagagacngccaacgaggcgaagcagccggccaatctagcatcagcgcgcggggtctgagagcagagcggcagggcgccatggcggcatcggtggcgctgagcagcgggcaccggatgccggcggtggggctgggcgtgtggcggatggagaaggcggacatccgcggcctcatccacacagcgctccgcgtcggctaccgccacctggactgcgccgctgactaccagaacgaagctgaagttggtgacgcgctcgcagaggcattccagaccggactcgtcaagcgggaggacctgttcatcacaaccaagctgtggaactcagaccatgggcatgtgcttgaagcctgcaaggacagcctgaagaagctgcagctagactatctcgacctctacctcatccatttcccagtagccactcggcacaccggagtcggcacgacttctagcgctctgggtgacgatggcgtgctggacatcgacaccactatctccctggaaacgacatggcacgcgatggaagagcttgtttccatggggctggtgcgcagcattggaatcagcaactacgacatcttcctcaccagagactgcctggcctacgccaagataaagccggcggtgaaccagatcgagacgcacccctacttccagcgcgactcacttgtcaagttctgccagaagcacgggatctgcgtgaccgcgcacaccccgctgggtggctccaccgccaacgccgagtggttcgggacggtctcgtgcctggacgaccctgtcatcaagagcttggctgataagtacggcaagacgccggcgcagctcgtcctccgctggggtctgcagcgggacacggtggtgatccccaagacctccaaggtggagaggctgcaggagaactttgacgtcttcggtttcgacatctccggcgaggacatggagaggatgaaggccatcgaccggaagtaccggactaaccagcctgccaagttctggggcatcgacctctatgcttagcttttagttcggttgcgttgcgtcgcgtactcgcgtgctgcgtctctcggcccccccagacaagacagcatcaataatgaggataccctcagacggcatcagtcaaagtcatgaggatctcagacagcatcttccatcacatgtgacggtgtgaggttgatggtagggtttggtatccccacgtgtccctctctctttcagctcagctaatcatcaccatgtagactacgcagtgtttgcctccgattatttactgtttttcttccttacaaaaaaaaaaaaaaaa

SEQ ID NO: 54 - protein, 311 aa, Zea mays
MAASVALSSGHRMPAVGLGVWRMEKADIRGLIHTALRVGYRHLDCAADYQNEAEVGDALAEAFQTGLVKREDLFITTKLWNSDHGHVLEACKDSLKKLQLDYLDLYLIHFPVATRHTGVGTTSSALGDDGVLDIDTTISLETTWHAMEELVSMGLVRSIGISNYDIFLTRDCLAYAKIKPAVNQIETHPYFQRDSLVKFCQKHGICVTAHTPLGGSTANAEWFGTVSCLDDPVIKSLADKYGKTPAQLVLRWGLQRDTVVIPKTSKVERLQENFDVFGFDISGEDMERMKAIDRKYRTNQPAKFWGIDLYA

SEQ ID NO: 55 - DNA, 1549 bp, Zea mays
cttctccctctcacaaaaccctagctttccctcctcccctgttttgcggcgcgccacgaactcgcgacgctctcgagagatccatggatcggcgcaagggcggcaaccgcgacaccaacggcagcctggtcgaggccacggcgtcgcggctgagggtcgaatccgacgaggaggcggaagaggtggggatggaggtggaagagagcttcgacgcgggggtggaagacgagcaggcggcggcggaggtgattggaagcgaaaagaccagcgccgactactacttcgactcctactcccacttcggtattcatgaagaaatgctaaaagatgtcgttcggacaaaaacatatcaaaatgttatcacccagagtagctttcttatcaagaacaaagtagtccttgatgttggtgctggaactggaattctttctcttttctgtgcaaaagcaggagctaaacatgtctatgcgattgaatgttcccagatggcagacatggcacaggaaattgtaaaatcaaatggatattcagatgtcataactgtaataaaagggaaagtggaagaaatagaacttccagtcccaaaagtagatgtcatcatctcagagtggatgggctatttcctcctgttcgagaatatgttgaacactgtcctatatgcacgtgataaatggcttgctgatggtggtgtggtcctgccagacaggacttctttgcgtcttactgcgattgaagacgcagaatataaggaagacaaaattgaattttggaataatgtatatggatttgatatgagctgcataaagaaacaggcgatgatggagccactggtagatacagtggatgcaaatcagattgtcactaactgccagttactgaagacaatggatatctccaaaatgaccccaggtgacgcgtcctttactgtaccattcaagctggtagcagagcggaatgattacattcatgctcttgtcgcatacttcgacgtgtcgttcaccaaatgccataagctgatgggcttctcaacaggcccgagatcgaaagccactcactggaagcaaactgttctctacctggaggatgttataactatctgtcagggggaaagcctgagtggttccatgacagtcacacccaataagagtaaccctcgagatatcgacattaagctcaagtactccataaatgggcataggtgtcaggtatcaagaacacagttctacaagatgcggtgacaatggaacaaacaagagttgcttcaaagctcattaaattttgtttaacgagtatcttgtttgacagaaattgtgctatttttattgttcatgtactatgcatcaaatattagattctttggaatctagcaaaagtagggagtagattaaactggtctgctgatatgagattgatgtagtgcaaaactgtcatattgccacaaggtcgttggtggttgtatgcatttgaaggcggttgcaaattattgctttacgcattccaccattaaaaaaaaaaaaaaaaaaaaaaaaaaaaaaaaaaaaaaaaaaaa

SEQ ID NO: 56 - protein, 384 aa, Zea mays
MDRRKGGNRDTNGSLVEATASRLRVESDEEAEEVGMEVEESFDAGVEDEQAAAEVIGSEKTSADYYFDSYSHFGIHEEMLKDVVRTKTYQNVITQSSFLIKNKVVLDVGAGTGILSLFCAKAGAKHVYAIECSQMADMAQEIVKSNGYSDVITVIKGKVEEIELPVPKVDVIISEWMGYFLLFENMLNTVLYARDKWLADGGVVLPDRTSLRLTAIEDAEYKEDKIEFWNNVYGFDMSCIKKQAMMEPLVDTVDANQIVTNCQLLKTMDISKMTPGDASFTVPFKLVAERNDYIHALVAYFDVSFTKCHKLMGFSTGPRSKATHWKQTVLYLEDVITICQGESLSGSMTVTPNKSNPRDIDIKLKYSINGHRCQVSRTQFYKMR

SEQ ID NO: 57 - DNA, 1493 bp, Zea mays
ctcgtgccgctcgtgccgaaaggaactaaggaaggcgagggccaccatccccaaaacccgtaaaaaaacccgaattgacaaattgagtcgacggggaaggaaataaagaaggggaagagcacgcgccgccgccagcaccgcgtccgccatggccgcctcctcccgccgcgcgtctcaattgctggggtccgcggcctcccgcctcctcctcgggcggggcttcgccgcggcagccgccgcggcgccctcgccggcggtcttcgtcgacaagagcacccgtgtgatctgccagggcatcacggggaagaacggcaccttccacaccgagcaggccatcgagtacggcaccaacatggttggtggagtgactcccaagaaaggtggaactgaacatttagggctcccagtgtttaactctgtagcagaagctaaggctgaaacaaaagccaatgcatctgttatatatgttccaccaccatttgctgccgccgctataatggaggcaatggaggctgagctcgaccttgttgtctgcattacggaaggaattccccagcatgacatggtgaaagtgaaggctgcactaaatagacaatctaaaactcgattgattgggccaaattgccctggtatcattaagcctggtgagtgtaaaattggaatcatgccaggttacatccacaagcctgggcgtattgggattgtatctcgttctggtaccttgacatatgaagcggtgtttcaaacaacagctgtaggcttggggcagtcaacttgtgtaggcattggtggtgacccattcaatggcacaaattttgttgattgccttgaaaaatttgtcgatgaccctcagacagaaggcattgttctcattggtgaaattggaggtacggctgaggaggatgctgcaacgttcatccaggaaagcaaaacacaaaagcctgttgttgcattcattgctggacttacggcacccccaggccgtcgcatgggtcatgctggagctatcgtggcaggaggaaagggtactgcccaggacaaaatcaaggcactcagagaggctggtgttaccgttgtcgagtcaccagcgaagattggttctaccatgtttgaaatcttcaaacagcgtggaatggtagaatagacacagtggtacagtagagagacattgagaaaccgctttttgatgcttgcgggcaatcgcgagcaattcctcggtagatccttctccctggccacaaacaaaactactgaggttttcttttcgtacttgtcttatctttggaagatgtcctggccttcttcacttggataacctttcgctgagctcatttcaataagacgtttcggagccatggaaatgctatgtcgcttggagtcaatgtggatgcctaatttcaaatttttattcttcatacatttcattctaggtttacttttctgtttgcttgtattatattatcagcgctacattgcccaaaaaaaaaaaaaaa

SEQ ID NO: 58 - protein, 331 aa, Zea mays
MAASSRRASQLLGSAASRLLLGRGFAAAAAAAPSPAVFVDKSTRVICQGITGKNGTFHTEQAIEYGTNMVGGVTPKKGGTEHLGLPVFNSVAEAKAETKANASVIYVPPPFAAAAIMEAMEAELDLVVCITEGIPQHDMVKVKAALNRQSKTRLIGPNCPGIIKPGECKIGIMPGYIHKPGRIGIVSRSGTLTYEAVFQTTAVGLGQSTCVGIGGDPFNGTNFVDCLEKFVDDPQTEGIVLIGEIGGTAEEDAATFIQESKTQKPVVAFIAGLTAPPGRRMGHAGAIVAGGKGTAQDKIKALREAGVTVVESPAKIGSTMFEIFKQRGMVE

SEQ ID NO: 59 - DNA, 2186 bp, Zea mays
ctcgtctcccggccctcccacaaaaaaaaactgctcggttgctgctcctgctccgccgcgccggcatcatgtgtggcatcttagccgtgctcggttgctccgactggtctcaggcaaagagggctcgcatcctcgcctgctccagaaggttgaagcacaggggccccgactggtcgggcctttaccagcacgagggcaacttcctggcgcagcagcggctcgccgtcgtctccccgctgtccggcgaccagccgctgttcaacgaggaccgcaccgtcgtggtggtggccaatggagagatctacaaccacaagaacgtccggaagcagttcaccggcacacacaacttcagcacgggcagtgactgcgaggtcatcatgcccctgtacgagaagtacggcgagaacttcgtggacatgctggacggggtgttcgcgttcgtgctctacgacacccgcgacaggacctacgtggcggcgcgcgacgccatcggcgtcaacccgctctacatcggctggggcagtgacggttccgtctggatcgcgtccgagatgaaggcgctgaacgaggactgcgtgcgcttcgagatcttcccgccgggccacctctactccagcgccggcggcgggttccggcggtggtacaccccgcactggttccaggagcaggtgccccggacgccgtaccagccgctcgtcctcagagaggccttcgagaaggcggtcatcaagaggctcatgactgacgtcccgttcggggtcctcctctccggcggcctcgactcctcgctagtcgcctccgtcaccaagcgccacctcgtcgagaccgaggccgccgagaagttcggcaccgagctccactcctttgtcgtcggcctcgagggctcccctgacctgaaggccgcacgagaggtcgctgactacctcggaaccatccatcacgagttccacttcaccgtacaggacggcatcgacgcgatcgaggaggtgatctaccacgacgagacgtacgacgtgacgacgatccgggccagcacgcccatgttcctgatggctcgcaagatcaagtcgctgggcgtgaagatggtgctgtccggggagggctccgacgagctcctgggcggctacctctacttccacttcgcccctaacaaggaggagttccacagggagacctgccgcaaggtgaaagccctgcaccagtacgactgcctgcgcgccaacaaggccacgtcggcgtggggcctggaggtccgcgtgccgttcctcgacaaggagttcatcaacgtcgccatgggcatggaccccgaatggaaaatgtacgacaagaacctgggccgcatcgagaagtgggtcatgaggaaggcgttcgacgacgacgagcacccttacctgcccaagcatattctctaccggcagaaagaacagttcagtgacggcgttggctacaactggatcgatggcctcaaatccttcactgaacagcaggtgacggatgagatgatgaacaacgccgcccagatgttcccctacaacacgcccgtcaacaaggaggcctactactaccggatgatattcgagaggctcttccctcaggactccgcgagggagacggtgccgtggggcccgagcatcgcctgcagcacgcccgcggccatcgagtgggtggagcagtggaaggcctccaacgacccctccggccgcttcatctcctcccacgactccgccgccaccgaccacaccggcggtaagccggcggtggccaacggcggcggccacggcgcggcgaacggcacggtcaacggcaaggacgtcgcagtcgccatcgcggtctgacgagagtacgtgctcgcgcacctccctgcttctaccgggctgcagcctgcagcctgcactgtgcgagcacagccgatcagcgccaataaactggaggataagaacgactggtaggtgtgtgtgtgtcgtgcgtgcccaccggccatatcccggtgcggcagcacgtgctattgttacgtgttgtactgccaccagcgtacgtgtctgtgtgtctcgatcatatctgtacctttttagatttagaagaaaaaaaaatgtgcccgtgtctgtatgtctggatcatatctgtacgttcttagatttagaagaaagaagaaaaacaatatatacgtaaaaaaaaaaaaaaaaaaa

SEQ ID NO: 60 - protein, 588 aa, Zea mays
MCGILAVLGCSDWSQAKRARILACSRRLKHRGPDWSGLYQHEGNFLAQQRLAVVSPLSGDQPLFNEDRTVVVVANGEIYNHKNVRKQFTGTHNFSTGSDCEVIMPLYEKYGENFVDMLDGVFAFVLYDTRDRTYVAARDAIGVNPLYIGWGSDGSVWIASEMKALNEDCVRFEIFPPGHLYSSAGGGFRRWYTPHWFQEQVPRTPYQPLVLREAFEKAVIKRLMTDVPFGVLLSGGLDSSLVASVTKRHLVETEAAEKFGTELHSFVVGLEGSPDLKAAREVADYLGTIHHEFHFTVQDGIDAIEEVIYHDETYDVTTIRASTPMFLMARKIKSLGVKMVLSGEGSDELLGGYLYFHFAPNKEEFHRETCRKVKALHQYDCLRANKATSAWGLEVRVPFLDKEFINVAMGMDPEWKMYDKNLGRIEKWVMRKAFDDDEHPYLPKHILYRQKEQFSDGVGYNWIDGLKSFTEQQVTDEMMNNAAQMFPYNTPVNKEAYYYRMIFERLFPQDSARETVPWGPSIACSTPAAIEWVEQWKASNDPSGRFISSHDSAATDHTGGKPAVANGGGHGAANGTVNGKDVAVAIAV

SEQ ID NO: 61 - DNA, 1500 bp, Zea mays
  misc_feature 449: n = A,T,C or G
ctcgcctctcttcttcggatcgagcagcagtactgcactgcatgccgccgatacaaatcccatcctctccctcctctactgcacctgcaccacagtagctagctagctatctttgctacggcggctctgtaatctggtccactagcgctccattcgaccccacccacagccatggctgccgtgaccgcggcggccgtctctctgccctcctcctcctcctcccctgccgccgccaaggccaaggcgtccgcgtccgcgtccccgtcgtctccatgcggccacctccagttcccgcggcggcacggcggcccgcgcgcggtgcggctgcgggtgcaggtgtccaccaccgagaccgcggaggcgagcggttcaagaagctggagaaggtgtccaagaagcaggaggaggggctcgtcaccaacaagtacaagcccaaggagccgtacgtngggaggtgccttctcaacaccaggatcaccggcgaccaagccccccggggagacgtggcacatggtcttcagcacagaaggcgaggtcccctacagagagggccagtccatcggcgtcatcgcggatggcgaggacaagaacggcaagccgcacaagctcaggctctactccatcgccagcagcgccctcggagatttcggcgactccaagacggtgtcgctgtgcgtgaagaggctggtctacaccaacgatcagggggaggtcgtcaaaggagtctgctcgaacttcctctgtgacttgaagccaggcgctgaggtgaagatcacagggccagtgggcaaggagatgctcatgcccaaagaccccaacgcaacaatcatcatgtacaccgggctggcgtggctgttcctgggcgtcccgaccagcgacaccctgctgtacaaggaggagctggagaagatgaaggagatggcgccggacaacttccggctggacttcgcggtgagccgggagcagacgaacgcggccggggagaagatgtacatccagacgcgcatggcggagtacaaggaggagctgtgggagctgctcaagaaggacaacacctacgtctacatgtgcgggctcaagggcatggagaagggcatcgacgacatcatgctcgacctcgcagccaaggacggtaagttgtctgtcatctctcttgtccttcgtttttgcgctcgatatgaacaagtagctagctaacttaacgtaccctttcttgctgcattggtttggttaatcatcatcatcatccgtcaggaatcaactggttggactacaagaagcagctcaagaagagcgagcaatggaacgtcgaagtctactgatgatgatccttcattatactgttcagctcaagcaatctggtggtgatgagtttgcattgcattgtacgtagtattgcggagatcaatcgaatcgtttggctcgtcgtcgttctatcgatgtacatacattatatatgatgaaagacatatataatcgtttctttcaaaaaaaaaaaaa

SEQ ID NO: 62 - protein, 341 aa, Zea mays
  VARIANT 93: Xaa = Any Amino Acid
MAAVTAAAVSLPSSSSSPAAAKAKASASASPSSPCGHLQFPRRHGGPRAVRLRVQVSTTETAEASGSRSWRRCPRSRRRGSSPTSTSPRSRTXGGAFSTPGSPATKPPGETWHMVFSTEGEVPYREGQSIGVIADGEDKNGKPHKLRLYSIASSALGDFGDSKTVSLCVKRLVYTNDQGEVVKGVCSNFLCDLKPGAEVKITGPVGKEMLMPKDPNATIIMYTGLAWLFLGVPTSDTLLYKEELEKMKEMAPDNFRLDFAVSREQTNAAGEKMYIQTRMAEYKEELWELLKKDNTYVYMCGLKGMEKGIDDIMLDLAAKDGKLSVISLVLRFCARYEQVAS

SEQ ID NO: 63 - DNA, 1946 bp, Zea mays
cgggacacccgccttgctcgcgccgcctcatcctctcactcctctcggacccccggtggccggtgcagagctgcgcgaccgagaaccgaatctgtgagccatgtcgaccaacaagggcagcgcggccaagggcggcggagggaagaagaaggaggtgaagaaggagacgaagctcgggatggcctataagaaggacgacaacttcggggagtggtactccgaggttgttgttaacagtgaaatgattgagtactatgacatttctggttgttatatattgaggccatgggcgatggaaatctgggagctactgaaagaattctttgatgcagaaattaaaaagctgaagctcaaaccatattatttccctttgtttgttactgagaatgttctacagaaggaaaaggaccacattgagggctttgcacctgaggtagcttgggttactaaatctgggaaatctgacctggaagcaccgattgcaatccgccccacaagtgagactgtcatgtatccatacttctccaaatggataagaagccaccgagacttacccttgaggtgtaatcaatggtgtaatgttgttagatgggagtttagcaatccaactcctttcataaggagccgtgaatttctgtggcaagaggggcatactgcttttgcgactaaagaagaggcagatgaagaggttctccaaatattggaactgtaccgaaggatatacgaagaatttttagcagttccagtttccaaagggagaaaaagcgagatggaaaaatttgcaggtggcctttataccaccagcgttgaggccttcattccaaacactggtcgtggcatacaaggcgcaacctcacactgtcttggtcaaaactttgccaagatgtttgatatcacttttgagaatgagaaaggtgttagggaaatggtttggcaaaactcttgggcctacacaacccgctcgattggagtgatggtgatgacacatggtgatgacaaaggcttagtattaccaccaaaggtggcgccaatccaggtaattgtgattccagtgccttataaggatgctgacacaactgccataaagggagcctgcgaatcaactgtttacacactcgatcaatctggaattagagcggatcaggacacccgtgaaaattactctccaggttggaagtattcccactgggaaatgaaaggtgttccattgagaattgagattggtccaaaagatctggcaaacaaacaggtgcgtgttgtccgccgggacaacggtgcaaaggttgacatccctgtgaccaatttggttgaagaggttaaagtgttactggatgagattcaaaaaaatctgttcaaaacagcccaagaaaagagagatgcctgtgttcatgtcgtgaacacttgggatgaattcacaactgctctgaataacaaaaagttgatcttggctccatggtgtgatgaggaggaaattgagaaagatgtaaaaactcggacaaaaggggaacttggagctgcgaaaacattgtgtactccatttgagcagccagaacttccagaaggtaccctgtgctttgcatctggaaagccagcgaagaagtggtcgttctggggccgcagctactgattgcctgtgctgggattatttctggattcagttctagtgagttatgtagctttgaagtgtcggatacaaatccaaaaatccatttacattgcgttttacatcgacttgcagttctcatgtcatcactgctgacaaaagccatcgatttcctgtggaccatgctattcgagtttgaatgttgcaaggatgagaatacgtacattcttttactggcgtgcagtgttataattagaaaaaacgcttcatatttgattgcaacacataattctgatcggaatttaactggatctctttatctctaaaaaaaaaaaaaaaaaaa

SEQ ID NO: 64 - protein, 508 aa, Zea mays
MSTNKGSAAKGGGGKKKEVKKETKLGMAYKKDDNFGEWYSEVVVNSEMIEYYDISGCYILRPWAMEIWELLKEFFDAEIKKLKLKPYYFPLFVTENVLQKEKDHIEGFAPEVAWVTKSGKSDLEAPIAIRPTSETVMYPYFSKWIRSHRDLPLRCNQWCNVVRWEFSNPTPFIRSREFLWQEGHTAFATKEEADEEVLQILELYRRIYEEFLAVPVSKGRKSEMEKFAGGLYTTSVEAFIPNTGRGIQGATSHCLGQNFAKMFDITFENEKGVREMVWQNSWAYTTRSIGVMVMTHGDDKGLVLPPKVAPIQVIVIPVPYKDADTTAIKGACESTVYTLDQSGIRADQDTRENYSPGWKYSHWEMKGVPLRIEIGPKDLANKQVRVVRRDNGAKVDIPVTNLVEEVKVLLDEIQKNLFKTAQEKRDACVHVVNTWDEFTTALNNKKLILAPWCDEEEIEKDVKTRTKGELGAAKTLCTPFEQPELPEGTLCFASGKPAKKWSFWGRSY

SEQ ID NO: 65 - DNA, 1611 bp, Zea mays
  misc_feature 74: n = A,T,C or G
cgcgtccacaaccgccgccaccgccttcccacttccaaatacgcctgctgccactttccccattcctgtctgancatccccacgcccccctgctgtggcctctgctctctcctgccagttcacctgctgcctccggtgcccgctgctgtgcatcgctcgctcaccaccaccaatcgccaccccgtgcggcagccgcgctgccatcccgcggaggactggaggagcacgcatatccgagccttccctgccgcgtcgcatggactcatgctgtcgcgggccgcctcccgcatcgcctccaaccgggtgcctgcctaactggccgattttcttcctcgcgtagccccattccgcagcacaaatagcgcgtcactttcccaatttctatcgcgtgccccccttccgatcctgccatttcgtgcatcctgtagcgtctggcagtgcgggggtcatcggggatggagtgggtggacaggaccaaggcctccgccgccgccgccgcagcggcggcggacgagagggctgggggagcggaagggctcgcgggatacgtcaaggtcatgaccgacgaacagatggaggtgctccgcaagcaaatctccatctacgccaccatctgcgagcagcttgtcgagatgcaccgcgccctcaccgagcaccaggacaccattgcaggaattaggtttagtaatctgtactgtgatcctcaaattatccctggaggccacaagatcacagcaaggcaacgatggcaaccaacaccaatgcagctgcagatcttggagaacatctttgaccaaggcaatggaacaccgagcaagcagaggataaaggagataacggcagagctctcgcaccatggccaaatctcggagacaaatgtgtacaactggttccagaacagacgggcacggtcaaagcggaagcaggccgcttctttaccgaacaatgctgaatctgaagctgaggtggacgaggagtctctcaccgataagaagccgaagtcagatcggtcgctccaggacaacaaggctatgggcgctcacaacgctgacaggatatctgggatgcatcacttggacactgatcatgaccaaatcggtggcatgatgtatggatgcaatgacaacggcttgagatcgtctggcagttctggccagatgtccttctacgggaacatcatgccgaatccaagaatcgatcatttcccggggaaggtggagagctcccggagcttctcccatctccaacacggggaaggctttgacatgtttggatgacatgatgcggcgctgagttaccgtgtaaaatgtgatggttgacacatcgtgcgttcaatttgctgacatgaaagttgatgttggatgtccgtgttgcttatcacgttctggttaaccacctccgcggatggtagctagcttgaatgaacctactctttgggatagctgtaagaggttgatattatagtttgccagtagtctatatacgctgaactatcagcatgtaattctccacgtttgcaaatttagcacgggtatgcagcagcctgtggttaaaccttcgtgtgtgaaaccaaaaaaaaaaaaaaaaaaaaaaaaaaaaaaaaaaaaaaaa

SEQ ID NO: 66 - protein, 273 aa, Zea mays
MEWVDRTKASAAAAAAAADERAGGAEGLAGYVKVMTDEQMEVLRKQISIYATICEQLVEMHRALTEHQDTIAGIRFSNLYCDPQIIPGGHKITARQRWQPTPMQLQILENIFDQGNGTPSKQRIKEITAELSHHGQISETNVYNWFQNRRARSKRKQAASLPNNAESEAEVDEESLTDKKPKSDRSLQDNKAMGAHNADRISGMHHLDTDHDQIGGMMYGCNDNGLRSSGSSGQMSFYGNIMPNPRIDHFPGKVESSRSFSHLQHGEGFDMFG

SEQ ID NO: 67 - DNA, 1730 bp, Zea mays
ccgcaattccgcatcacgcagaggcagagcgaccaacccagaaccccaccccaccgcccgcaaccgcaagctcagattccctccccaccccaccccaccccaccgtcccgctcactccagcccagcccgcgtccccacagcccagcgacagcgggcaccggcggcatccagccatgtgcggcggcgccatcctgtcggacatcatcccgccgccgccaccgcggcgggtcacggctggccacctctggcccgagagcaagaagccgaggagggctgcatccggcaggaggggagcccccgtggagcagcatgagcaggaggaggatttcgaggccgacttcgaggagttcgaggtggagtccggcgagtcggagctcgagtccgaggacgagcccaagcccttcgccgcccccaggagcgcgctcgccagaggtggactaaacactggtgcagctggtgtcgatggccctgctgcaaattcagttaaaaggaagaggaagaaccagttcaggggtatccgccggcgcccgtggggcaaatgggctgctgagatcagagatcctcgcaagggcgtgcgcgtctggctcggtactttcaactcccccgaagaagctgccagagcttacgacgccgaggcacgcaggatccgcggcaagaaggctaaagtcaacttcccggatgaggttcctacggcggtttctcagaagcgccgtgctgctgggcctgcctctctgaaagcgcctaagatggacgttgaggaggagaagccgatcatcaagctcgcagtgaacaatatgaccaactcaaacgcatatcactaccctgccgtcgtcggccacaacatcatacccgagccattcatgcagactcagaacatgccattcgctcctctggtgaattatgctgccctagtgaacctgtcttcagaccaaggcagcaactcgttcggttgctcggacttcagcctcgagaacgactccaggacccctgacataacttcggtgcctgcgcccgttgccaccttggccgccgttggcgagtctgtgttcgtccagaacaccgccggccatgctgtggcgtctcctgcgacggggaacactggtgttgatctcgccgagttggagccgtatatgaatttcctgatggacggtggttcagacgactcgatcagcactctcttgagctgtgatggatcccaggacgtggtcagcaacatggacctttggagcttcgaggacatgcccatgtctgctggtttctactgaggctgaggcccagcgactggtgcttgtgtacatagggggggacaaagggtaagagcctgcagtaacagagattggctctttctggtacttgcaatttctatcccttcaactctttcttccgcccccgtgtttcaggaataatgttctggagatgaagaaacgcttgcgtgggcgtgcctgcaggcacgcgtgtagtagctgcggtattagtatatatgcttagatgttcagtcacttcctttaagtacaatttggcgctggacatgtaccttattttactatgtatccgtgacaacagctatgtgtctgctccttttattttcttgtctttgcttcaaaaaaatggctctgaacattgcgagtttgtactttgtagacaatatatatatatatatatgtgtgtaaaaaaaaaaaaaaaaaaaaaaaaaaaaaaaaaaaaaaaaaaaaaaaaaaaaaaaaaaaaaa

SEQ ID NO: 68 - protein, 363 aa, Zea mays
MCGGAILSDIIPPPPPRRVTAGHLWPESKKPRRAASGRRGAPVEQHEQEEDFEADFEEFEVESGESELESEDEPKPFAAPRSALARGGLNTGAAGVDGPAANSVKRKRKNQFRGIRRRPWGKWAAEIRDPRKGVRVWLGTFNSPEEAARAYDAEARRIRGKKAKVNFPDEVPTAVSQKRRAAGPASLKAPKMDVEEEKPIIKLAVNNMTNSNAYHYPAVVGHNIIPEPFMQTQNMPFAPLVNYAALVNLSSDQGSNSFGCSDFSLENDSRTPDITSVPAPVATLAAVGESVFVQNTAGHAVASPATGNTGVDLAELEPYMNFLMDGGSDDSISTLLSCDGSQDVVSNMDLWSFEDMPMSAGFY

SEQ ID NO: 69 - DNA, 1492 bp, Zea mays
ccaaacaacggcagctagcgagctcccgcggtcccgccgccgccccctggtcctccaaaaaacggctgaaccctaaaccctccctagctcccgccgcctcgcttaaccgcgcccatggccgccgccgctcgcgccgccctcccgcggccccacctctctcttttttcgtcctcccaccgcagcccccatctgtccctcacgccctcctccgcccctcgcctgcgcagcggcgctgccacctcccctgcgctgcagcagcaccaccaggtcaccacgcgcctgggcgacgtgatcgaggcgcagcagttcgaccgggacgcgctgaacgagatcttcgaggtggcgcgggagatggaggccgtggagaggggttcccacggcgcccccagccgcgtcctcgaggggtacctcatggccacgcttttctacgagccctccacgcgcacgcgcctctccttcgaggctgctatgcggaggctcggcggggaggtcgtcaccaccgagaatgcgcgcgagttctcttccgccgccaagggggagacactcgaagataccataagaaccgttgagggttattccgatattattgtactgagacattttgaaagtggagctgcaaggaaagcagcagatactgcaaatattcctgttattaatgcaggtgatggaccagggcaacatccaacccaggctttgttggatgtgtacacaataaagagagaaattggcacactagatggaattaaacttggtttggttggtgaccttgctaatgggaggacagttcgttctctggcttacttgattgctaagtaccagaacattaagatatactttgtatctcctgatgttgttaaaatgaaggatgatatcaagaactacttaaattccaaaggtgttgaatgggaagaaagttcagatttgttggaggtggcatccaagtgtgatgttatttatcaaacacgtattcaaaaagaaagatttggtgagaggattgacctttatgaagctgctcgtggcaagtacatcgtggataaaaaggtcttagatgtgctgccaaaacatgctgtcatcatgcatccccttccaaggcttgatgagatcacagtagaagttgatagtgatcaaagagctgcatattttaggcaggctaagaatggcctctacataaggatggcattgctcaaacttctgcttgttggtcactgacatttcggctagtgctttagcttgtgctgcgtcaagggattagaaggtattattcttaatataatgatcgaggctgtcttacccacgcaggtcgagtttttagaaacatgtactaataatcagcagcttgtgtcaaaattcaatgttcgctgttgcaggtaataaaagtctgcatccatgcgaatgtgcagcgatgtttggcagagtttggtgttctcatgtgctgtgagaacatggaacataattaattttgcctgcacaaaaaaaaaaaaaaaaaaaaaaa

SEQ ID NO: 70 - protein, 364 aa, Zea mays
MAAAARAALPRPHLSLFSSSHRSPHLSLTPSSAPRLRSGAATSPALQQHHQVTTRLGDVIEAQQFDRDALNEIFEVAREMEAVERGSHGAPSRVLEGYLMATLFYEPSTRTRLSFEAAMRRLGGEVVTTENAREFSSAAKGETLEDTIRTVEGYSDIIVLRHFESGAARKAADTANIPVINAGDGPGQHPTQALLDVYTIKREIGTLDGIKLGLVGDLANGRTVRSLAYLIAKYQNIKIYFVSPDVVKMKDDIKNYLNSKGVEWEESSDLLEVASKCDVIYQTRIQKERFGERIDLYEAARGKYIVDKKVLDVLPKHAVIMHPLPRLDEITVEVDSDQRAAYFRQAKNGLYIRMALLKLLLVGH

SEQ ID NO: 71 - DNA, 1853 bp, Zea mays
caggcgcagcagcacggcagtcctccgtttcctcctcgtcgctcgccccggttgtctcctcctcgacctcccccgtcgcgacaccgcccgatctctctagcgcacggcggacggagaagaggaggagggggggacgatctcattcatcggaccggcgtgcctgtgtcgtctgctgttttcgttattttttctttactctttttttttcttcctcctttgcttgttcaattcaatcagtataataagatttctgatttgggggcggctcgccatgggattcggaatggggaataataacaacggggcgagctcctcgtcgtcgaggctggaccgggcggcgccgctgctgccgcgccacggcagcagcgggggccgcgagggtggtggcctgtcgtcgcagcccaagacgttcgccaacgtcttcatcgcggtggtcggcgccggcgtgctggggctgccgtacaccttctcgcgcaccgggtgggcggcgggctcgctgctgctcttctccgtcgccgcgctcaccttctactgcatgatgctgctcgttgcgtgccgccgccgcctcgccgacgagcaccctaagatcgcctcgttcggggacctgggggacgccgtgttcggcgcgcatgggcggttcgccgtggacgtgatgctggtgctcagccaattcagcttctgcgtcggctacctcatcttcatctccaacaccatggcgcacctctatccgattaccgccgcggcgtcctcatcctccgcgctcctctcccccaaggcgctcgtcatctgggcgatgctgcctttccagctcgggctcaactccatcaagacgctgacgctgcttgcgccgctcagcatcttcgccgacgtcgttgacctcggcgccatgggcgtggtcctcggccaggacgtcgccgcctggctcgccaagcccgtgcccgtggtcgccttcggcggcgctggcgcgcttctctacgggctcggcgtctccgtgtacgcgttcgagggcatcggcatggtgctgccgctggaggcggaggcggcgaacaagagcaagttcggcgtcacgctcgggctgtccatggcgttcatcgccgtcatgtacgggctgttcggcgtcatgggctacgtcgcgttcggcgacgccacgcgggacatcatcaccaccaacctcggagccgggtggctgtcggccgccgtgcagctggggctctgcatcaacctcttcttcaccatgccggtgatgatgaaccccgtgtacgaggtcgccgagcgcctgctccacggcaagcggtactgctggtggcttaggtggctgctggtcgtcgtcgtcggactcgccgccatgtacgtgcccaacttcacggacttcctggcgctcgtcgggagcagtgtctgcgtcctcctcgggttcgtgctgccggcctcgttccacctcaaggtattcggcgccgagatggaatggcccggagtgctgtccgatgtcctgctggtcgtgatcggcctcgcgctcgccgtgttcgggacgtacacgtcgctgctgcaaatcttccaatcgtcaagcgcttgatcgacgcgcgttccgctgcgcgtcgatcatcgcattctccagggcaactacgatacatgtgttgagtgttgttcgtgagtggcttgtattggacgggggaaatctgtacgcttttcgtaccacagatttcagttactcccggtagcagtgtatgtgtatgcgtcctagatgttcctcctgctgtgcacgatgggggatacgatgaaaggacaagattttcacttcgtggaaaaagcttattttgctgttaaaaaaaaaaaaaaaaaaaaaaaaaaaaaaaaaa

SEQ ID NO: 72 - protein, 432 aa, Zea mays
MGFGMGNNNNGASSSSSRLDRAAPLLPRHGSSGGREGGGLSSQPKTFANVFIAVVGAGVLGLPYTFSRTGWAAGSLLLFSVAALTFYCMMLLVACRRRLADEHPKIASFGDLGDAVFGAHGRFAVDVMLVLSQFSFCVGYLIFISNTMAHLYPITAAASSSSALLSPKALVIWAMLPFQLGLNSIKTLTLLAPLSIFADVVDLGAMGVVLGQDVAAWLAKPVPVVAFGGAGALLYGLGVSVYAFEGIGMVLPLEAEAANKSKFGVTLGLSMAFIAVMYGLFGVMGYVAFGDATRDIITTNLGAGWLSAAVQLGLCINLFFTMPVMMNPVYEVAERLLHGKRYCWWLRWLLVVVVGLAAMYVPNFTDFLALVGSSVCVLLGFVLPASFHLKVFGAEMEWPGVLSDVLLVVIGLALAVFGTYTSLLQIFQSSSA

SEQ ID NO: 73 - DNA, 1735 bp, Zea mays
agccagagccagagccagccagccagacacacaacctcggtcggcgcggcggctcaacccaatggctccttcctccctccgcccgccgcgccaccacccgtctcccctcgtcgtcctcgccatcgccgtcctcctcgtcttgcgcaccgccgatgggctgccggaggcgggaggaggaggaggaggcggcggtctgtaccgggagattctcagggacgagaccgtgcagaggctcaaggagctgggcaagatatctgatggggatggctaccttgaaaggacgtttctgagtccggcctctatcagagccactggtgtcatcgtcagctggatgaaagacgctgggcttacgacgtgggtcgatcagatggggaatattcatggtcgatatgagccggcaaattctaccagagatgccttgttgattggatctcatatggacactgtcgttgatgctgggatgtacgatggagccttgggtattatttcagcaatctcagcactgaaggttttgaaagttacggggaaactccagaggttaacgagaccagtggaggtcattgcattcagcgatgaggagggcatcagattccagacaacttttctgggaagcgctgctgtagctggtacactacctgaatcaattttacaagtatcagataagagtggcactacactacaagatgttctgaaaatgaattcttttgaggctacctctactgctattagtcaagccaggtacaacccggagtctgtggggagttatgttgaggtacacatggagcaaggccctgtcctggaagcccttcattatccacttggtgttgtaaaaggaattgcaggacagacacgattgaaggtaatagtagatggttcgcaagggcatgctggcacagttccaatgaaattgcgccgtgatccgatggttgcagctgcagagctcgttgtgactctggaacgcctctgtaaagagcccaacagtttgctgacctacgacgaggagtgcagctgcttcactgaggagtccctggccggcctggtgtgcaccgtcggcgagctgaacacgtggccaagcgcgagcaacgtgattccgggccaggtaaacttcacggtggacatccgcgcgatggacgaccaagtgagggagacgatcgtgacgagcttctcgaggcttgttctccagaaatgcgatgacagactggtcgattgcaaggtcgagcataagcactcggcggcagcgacgcactgcgacccggagttaacgtctcagctgaagcgcgcggcgcggtcgaccgtgtcggcaatgccggggcgcaccgtggcggccggcgagacgcccgtgctgatgagcggcgcagggcacgacgcgatggcgatggccaggctcaccaagatcgggatgctgttcgtgcggtgccgcggcggcatcagccactcgccggaggagtcggtgatggacaacgacgtgtgggccgcggggctcgcgctgttcaacttcatcgaccagaacgcggtgtcagaagaactggatgccgggcagaacgtggtggctgtggcgctggcggtggcagagtcgtgatggttcggtggcgattcttttcagtgggagtaggcctgtagcctgcaactgtacataagacttgttattacattgcattaaacaggaataaaaaaaacgcttctcttcgttgaaaaaaaaaaaaaaaaaaaaaaaaaaaaaaaaaaaaaaaaaaaa

SEQ ID NO: 74 - protein, 505 aa, Zea mays
MAPSSLRPPRHHPSPLVVLAIAVLLVLRTADGLPEAGGGGGGGGLYREILRDETVQRLKELGKISDGDGYLERTFLSPASIRATGVIVSWMKDAGLTTWVDQMGNIHGRYEPANSTRDALLIGSHMDTVVDAGMYDGALGIISAISALKVLKVTGKLQRLTRPVEVIAFSDEEGIRFQTTFLGSAAVAGTLPESILQVSDKSGTTLQDVLKMNSFEATSTAISQARYNPESVGSYVEVHMEQGPVLEALHYPLGVVKGIAGQTRLKVIVDGSQGHAGTVPMKLRRDPMVAAAELVVTLERLCKEPNSLLTYDEECSCFTEESLAGLVCTVGELNTWPSASNVIPGQVNFTVDIRAMDDQVRETIVTSFSRLVLQKCDDRLVDCKVEHKHSAAATHCDPELTSQLKRAARSTVSAMPGRTVAAGETPVLMSGAGHDAMAMARLTKIGMLFVRCRGGISHSPEESVMDNDVWAAGLALFNFIDQNAVSEELDAGQNVVAVALAVAES

SEQ ID NO: 75 - DNA, 1579 bp, Zea mays
agacaacacgccagcccctcaccttttttctctctcaacccgccagcgccaccagcaacttccctcagatcccatccacccctcgctattaaagcagcccaggccgccgcccgccgccgctcacccaccaatccacagcgagacccgaccccgccgtcgcgatgaggccggcgctgctcaagtccacggccgagctcctccgccgcagccgcggctacgcctcctcggccaacccggagcggaaggtggccatcctgggcgctgcgggcggcatcgggcagccgctctccctcctcatgaagctcaacccgctcgtctcctccctctccctctatgatatcgccgggacccccggcgtcgcggccgacgtctcccacatcaactcccccgccctggtgaaggggttcatgggggacgaccagctcggggaggcgctcgagggctccgacgtcgtcatcatcccagccggggtgcccaggaagcccggcatgactagggacgacctcttcaacatcaacgccggcatcgttaaggggctctgcactgccatcgccaagcactgccccaacgctcttgtcaatatgatcagcaaccctgtcaactccactgtcccgattgcggcggaggttttcaagaaggctggtacttatgatgagaagaagctgtttggtgtgactactcttgatgttgttcgtgctaaaactttttatgctggaaaagcgggtgtgccagttactgaggtgaatgttcctgttgttggaggccatgcgggtattactattctgccactcttctcgcaggccactcctgcaagcaattcgttgtcccaagaagacattgaggccctcaccaagaggacacaagatggtgggacagaggtggttgaagcaaaggcgggaaaaggctctgcaacgttgtccatggcatatgctggtgctgtttttgcagatgcatgtttgaagggtctgaatggagttccagacattgtagagtgctcttttgtgcaatcaactgtgacagagttgccattctttgcctccaaggttcggctcggcaagaatggagtggaggaagtgcttggtctgggtgagctcaacgagttcgagaagaaggggctggaaaacctcaagggcgagctcaagtcttccatcgacaagggtatcaagtttgcccacgggaactaggcacccttgcccggcttctaacaattgatgccccttgcatttttgtttgactgcctatttttcctgccccccgtatggttggggcaatgaggcgtagtggtcgataataaaacccagcggaacaaagaaaacgtgtaccagaaactgtttgcaaacaccggtgccttttttttgtgttgaaccaccattagttgagccgtgagggaatggtgaacaagctttccacttgctcatttccgagcgcttctctttgattgtatgcatggtttggactcatgactggacttcttggcagttggcttggcacccaggaatctaatcactggagttgctgctgttatcgagattttgcagcgttgcattctaaaaaaaaaaaaaaaaaaaaaaaaaaaaaa

SEQ ID NO: 76 - protein, 340 aa, Zea mays
MRPALLKSTAELLRRSRGYASSANPERKVAILGAAGGIGQPLSLLMKLNPLVSSLSLYDIAGTPGVAADVSHINSPALVKGFMGDDQLGEALEGSDVVIIPAGVPRKPGMTRDDLFNINAGIVKGLCTAIAKHCPNALVNMISNPVNSTVPIAAEVFKKAGTYDEKKLFGVTTLDVVRAKTFYAGKAGVPVTEVNVPVVGGHAGITILPLFSQATPASNSLSQEDIEALTKRTQDGGTEVVEAKAGKGSATLSMAYAGAVFADACLKGLNGVPDIVECSFVQSTVTELPFFASKVRLGKNGVEEVLGLGELNEFEKKGLENLKGELKSSIDKGIKFAHGN

SEQ ID NO: 77 - DNA, 1925 bp, Zea mays
acgaggcccctgcctcccaaccgcgccgtcacctccctcactcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcaccagcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttggctctacttatctgattatcatttgtaagcgatttgctcaagttatttgtcgtttatgaataacttgctttcctcaagagcatacttaaagacggaaaaaaaaaaaaaaaaaaaaaaaaaaaa

SEQ ID NO: 78 - protein, 485 aa, Zea mays
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 79 - DNA, 2015 bp, Zea mays
  misc_feature 1969, 1970: n = A,T,C or G
ttcgaatgcagccgtgccgagtccgccgcctccgcctccgccgccgccgccgccgtgaacgagagtgatgcgcctcgcgtcctatgcctttctacgccgcgccgccgccatgtcctccccctcctcctacagccgcacaggctacccccgccctcgccgcggctactcgggaaggccctcgccgccgccgccgccgccgcccccggacgcggcctccgagatcgtcagcagggattaccatctcagtgccgtgcacgccgccaacgaatccctgcgtcgtggcggcggcggcgacatccgctggcctccaccgccatacaggcaggggcctcaccctcaccaaccgcactatggctatggctatggctacggatacggatacggccaaacgtggcagccgggtccatcctatgggtttgtgccgtacaactacggccacccgcagcagcagccgccggggcctcagtacggctacggggctccgaacccgtacgttcacgggcacctgcagccgcagccgcatgtgcgtggggcagcgagtccagggttccgtcctggcgcgccccagctgactccgaggctggcagattacctccgacggtggcgctttgcaaagcagaggccgccacatcaagctgggaggtttattattctatcatacaatatacttgcggactatctggcccaggagcaccgctttctttatgaaaaaatatcaccttttattttggattggaactggcgcaaggataagttactgtttgagttcggtctgtggtctccagacattctatgtcttcaggaggttgacaaatttacagaccttgaacaagaaatggcaagccaaggatataacggtacatggaagatacggactggagatgcagctgatggatgtgctattttttggagaacaacaaggttccagttgcgttatgaagaagacattgagttcaccaagcttggacttcgtgataatgttgcccagctctgtgttttagagtcggtgggccttcagtatgtgcaaactgactctgttagtttatctacaagttctaaccatccacaacaagctaaacaagttataatatgtaacattcacgttctttataatccaaagagaggggacatcaaacttggtcaggtcaggacacttctggataaagctaacgctctatctaagatgtggaatgatgctccagtgatagtttgtggagattttaactctacacccaagagtccattgtataattttatgttggggcaaaagttgaatttgtctggccttgcgagaaatactatatctggacagcaaattggtggtagttcacaggggctatatactggccctaatatatctgggtggacaccagaagaaatcaaagctgccactgggaaggatgaatgcactttcatgaaacacagtttgaaattaaggagtgtatatactgacgtcgaggattttgaaggaacaaaagacgccagcaaggaaccactggtgacaagctacaacagaaaattcatgggaacagtagactacatatgggcctcggagggtctgcatactgttaaagtcttggacacatttcccatagagattttgaaaaaaacaactgggttcccgaccaagaaatggggaagcgatcacattgcccttgcctgtgaattggcttttacaaaatgacgccttttatcaggcggagagggcgcctgcatagttgctagtgaccaaacacacctcaagagaaagaatactgtctacaggacgattaactgaaccaaacctcgctcttttagagctcgttaatttatttcatttttttttcgacacacctttttgaattgtgcgtgagtatggagaaccggagtacatcatttgggtccaattttagagcattgttcctgtttgattggctatggagagtgtattttggtgtgctgccactctacctgcggccctgccatctannggttcaatgacttgtttgagtcagtatgccctgcacggcactgtt

SEQ ID NO: 80 - protein, 538 aa, Zea mays
MRLASYAFLRRAAAMSSPSSYSRTGYPRPRRGYSGRPSPPPPPPPPDAASEIVSRDYHLSAVHAANESLRRGGGGDIRWPPPPYRQGPHPHQPHYGYGYGYGYGYGQTWQPGPSYGFVPYNYGHPQQQPPGPQYGYGAPNPYVHGHLQPQPHVRGAASPGFRPGAPQLTPRLADYLRRWRFAKQRPPHQAGRFIILSYNILADYLAQEHRFLYEKISPFILDWNWRKDKLLFEFGLWSPDILCLQEVDKFTDLEQEMASQGYNGTWKIRTGDAADGCAIFWRTTRFQLRYEEDIEFTKLGLRDNVAQLCVLESVGLQYVQTDSVSLSTSSNHPQQAKQVIICNIHVLYNPKRGDIKLGQVRTLLDKANALSKMWNDAPVIVCGDFNSTPKSPLYNFMLGQKLNLSGLARNTISGQQIGGSSQGLYTGPNISGWTPEEIKAATGKDECTFMKHSLKLRSVYTDVEDFEGTKDASKEPLVTSYNRKFMGTVDYIWASEGLHTVKVLDTFPIEILKKTTGFPTKKWGSDHIALACELAFTK

SEQ ID NO: 81 - DNA, 801 bp, Zea mays
ggacgaaggaaggttccagcgaccgtggagtaggagaaagcgcgatggggaagaagcggcagcttatctgcctcgcagccgccgtcgccgccgcggccatcctcctgacagcgtcggccaagaagtccagcgacgtcaccgagcttcagatcggcgtcaagtacaaaccggagtcatgtaccctgcaagcacacaaaggagacaaaattaaggttcattatcgtggggcactcactgacggatcagtttttgattctagctatgacagaggtgacccgtttgaatttactcttggaaatggccaagtgataaaaggctgggaccaaggattgctaggtatgtgcgtcggtgaaaagcggaagctaaagatacctgcaaagatgggctatggcgagcgaggctccccaccgaagattccaggcggagcgactctggtcttcgacacggagcttatcgccgtcaacgggaagacatctggcggtgcaaatccagaaactgaaagtgagctctgatacgatgcatttggatggagagtttcagctcgagggagtagtagcagagtcacgtagttcatttggtgccgtgaaagggctgttgtcttgtttccttcatgcatggcaatttatgttttagagatgtcatactctggaagcagttccctttttttgatggtacgaaagctcgatttgtcaagctaccatggccttcaacattgaagcaggtctggactgttgttgcatcgatccacgggtcggaaaatttcaaatgtaatgagtggtgaggcagcattttcgccgaaaa

SEQ ID NO: 82 - protein, 155 aa, Zea mays
MGKKRQLICLAAAVAAAAILLTASAKKSSDVTELQIGVKYKPESCTLQAHKGDKIKVHYRGALTDGSVFDSSYDRGDPFEFTLGNGQVIKGWDQGLLGMCVGEKRKLKIPAKMGYGERGSPPKIPGGATLVFDTELIAVNGKTSGGANPETESEL

SEQ ID NO: 83 - DNA, 1265 bp, Zea mays
gcggccgcctgtccgcagctggcctcggcgcagccagcgccgggcatgcctccgccgtccccggccgcgaacaactcccggctggagaaggcgtacgtggcgctgcaggcgctgaagcgcgccatcacggacgaccccaagaagctgaccaagaactggtgcgggcccgacgtgtgcagctacttcggcgtgttctgcgcgccggcgcccgacgaccccttccagcgcacggtggcctccgtggacctcaaccacggcgacctcgccgggacgctgcccgaggagctgggcctcctgtccgacctcgccgtcttccacctcaactccaaccgcttcagcggctccctccccgactcgctccgctccctccacctcctccacgagatcgacgtcagcaacaaccagctctccgggcccttcccgccgcagctcctctgcctccccaacgtccagtacgtggacatcaggttcaacaacttctgcggcgaggtgccggcggccatcttcgacaagaaggtcgacgcgctcttcatcaacaacaaccacttcgagttcacgctgcccgacagcttcaccaactcgacggcgtcggtgatcgtgctggccaacctgcagcgggtcagcggctgcctgccgagcagcatcggcgacatggccgccacgctcaacgagctgatcctgctcaacagcggcatctcctcctgcatcccgcccgagatcggcaagctggacaagctcaccgtgctggacctcagcttcaacagcatcgccggcaccctgccggacacgatcggcaacatgcgggcgctggagcagctcgacgtcgcgcacaaccgcctcgccggcgagataccggagagcgtctgcggcctgccgcacctcaagaacttcacctactcgtacaacttcttctgcggcgagccgcaccggtgcctcgaggtgccgcgcgtcgacgaccgccagaactgcatcgccgggcgccccgaccagcgcccgggcgaggagtgcatctcgttcctgcaccagccgagggtgcgctgcgacgcccacgggtgcatcgcgccaccgtcttcgccacctccacctccacctatgcatgctcctccgccgcctgtatactgatccgtgaaccgtggtaactcgcgatttgcttcccttgctagcttgtggtgtcaaaatcgaaagggtaaatgcatacacatggtatatactgtaacttttatttctcagcaaaagattaataatggattcatagatttttcatc

SEQ ID NO: 84 - protein, 358 aa, Zea mays
MPPPSPAANNSRLEKAYVALQALKRAITDDPKKLTKNWCGPDVCSYFGVFCAPAPDDPFQRTVASVDLNHGDLAGTLPEELGLLSDLAVFHLNSNRFSGSLPDSLRSLHLLHEIDVSNNQLSGPFPPQLLCLPNVQYVDIRFNNFCGEVPAAIFDKKVDALFINNNHFEFTLPDSFTNSTASVIVLANLQRVSGCLPSSIGDMAATLNELILLNSGISSCIPPEIGKLDKLTVLDLSFNSIAGTLPDTIGNMRALEQLDVAHNRLAGEIPESVCGLPHLKNFTYSYNFFCGEPHRCLEVPRVDDRQNCIAGRPDQRPGEECISFLHQPRVRCDAHGCIAPPSSPPPPPPMHAPPPPVY

SEQ ID NO: 85 - DNA, 1887 bp, Zea mays
gcgattattccagataagcacgatccgatgatggccccaccgatatccgccgatgccttggtggaggctgcctcggccgtcgccgcgtacccagccatcgcgccgaacagaatgctttgcaaggacgcgccggcgccggccatctctgtcgtctcgaagcagacggtccggcccgccggcgcgtcggcggcggtcggcagtggagacctcaggctctcggtgtcggacatgccgatgctatcgtgccactacatccagaaggggctgttcttcccgccgcctcctcccggcgtgctggcggcctcgctggtgtcgtcgctcgtggcggcgctctcccgcgcgctcggcgtcttccccgcgctcgccggccgcctcgtcacgctccacgacgacagcatcgtgatacggtgcggcggcgacgacgccgccgtcgagttctaccacgcggtggcgccgtctctgtcgctcggcgacttcctggtgcccggcgccgacgtgccgacccgtttgacgaacggcctgttccccatggaccggacggtgagctacggcggccacggccgcccgctcacggcgttccagctcaccgtgctcggcgacggcgccgtgttcgtcggcttcgtcgccaaccacgccgtcgtggacggcacctccttctggcacttcttcaacacgtgggcggggctgtgccgcggcgcgccggtccgggagcccgacttccgccgcaacttcttcggcgactccaccgccgtcctacgcttccccggaggcgcgagccccgccgtgacgttcgacgccgacgcgccgctccgcgagcggatcctccacttcagtgctgccgcaatcagcgagctgaaggcgacggccaaccgctcgaaaagagcaggtcaggaagccgaggctaacggcaagctcgcgcacgacgactccagacttgaagggcgttccggtgaaatctcgtcgtttcagtcgctgtgcgcgcacatctggagggcggtgacgcgcgcgcgccggctgctggctgccgacaagacgacgacgttccgcatggccgtgaactgccggcaccgtctgcgcccggcgatctccccgctctacttcggcaacgcgatccagagcgtggcgacgacggccaccgtagccgagctggcgtccaacgacctgggctgggcggccgcccggctgaacgccaccgtggcgtcgcacaaggacggcgcgatccggcgcgccgcggcggagtgggaggccgcgccccgttgcttcccgctaggcaaccccgacggggcggccctcacgatggggagctcgcctcggttcccgatgtacgacgggaacgacttcgggtggggccgcgcgctcgccgtgcggagcggccgcgcgaacaaattcgacggcaagatgtcttcgttccccggacaggctggggacggtagcatcgacgtggaggtgtgcctcgcgccagacaccatggcgcatctcctcctcgacaaggagttcttgcagtacgtgtcctcccctgcaccgtgaggcggtgacagagtgaatgtgtggcttgttgctgcgcagctacatatagtaactggatttgtaccctttcagcagatatcaagtgcttgccaactttaatgagtttgagtgaccatgtagatgtagagaggctgttctgctgtttccttcgtgatgccgttgtaggctagcagcactagttatggcttccgagcaggtgtggcaaaacggttatgacttatgatagacggatatggtttttaggctcctttgtgttaagtaaccctagttagggttatgtgcacaaatacttgctttgtccctgaggggtctcacctctctatataaggaacctatacaccccctcataatacagagaag

SEQ ID NO: 86 - protein, 499 aa, Zea mays
MMAPPISADALVEAASAVAAYPAIAPNRMLCKDAPAPAISVVSKQTVRPAGASAAVGSGDLRLSVSDMPMLSCHYIQKGLFFPPPPPGVLAASLVSSLVAALSRALGVFPALAGRLVTLHDDSIVIRCGGDDAAVEFYHAVAPSLSLGDFLVPGADVPTRLTNGLFPMDRTVSYGGHGRPLTAFQLTVLGDGAVFVGFVANHAVVDGTSFWHFFNTWAGLCRGAPVREPDFRRNFFGDSTAVLRFPGGASPAVTFDADAPLRERILHFSAAAISELKATANRSKRAGQEAEANGKLAHDDSRLEGRSGEISSFQSLCAHIWRAVTRARRLLAADKTTTFRMAVNCRHRLRPAISPLYFGNAIQSVATTATVAELASNDLGWAAARLNATVASHKDGAIRRAAAEWEAAPRCFPLGNPDGAALTMGSSPRFPMYDGNDFGWGRALAVRSGRANKFDGKMSSFPGQAGDGSIDVEVCLAPDTMAHLLLDKEFLQYVSSPAP

SEQ ID NO: 87 - DNA, 1418 bp, Zea mays
gcgaggctggtctccgctgttacgtctctgcccgcctctcccccacccctcctctggtccaagtccccccaccgcagcggccccactccatccgagtctcttcgactccaagccgttccgctccccctgttccgcgcgacgccgatgcaccccaagctgccgcgggccgcgcgcaggctcctctgctgcggcggggccgccgcgtccccggaggaggacctgtctgacgaaggaaggcgatcgttgaggtgggtgttctcattgagagagcttcgatcagcaacaaacagcttcaattacgataacaagatcggagaagggccacttgggagtgtgtactggggacaagtctgggatggttctcagattgctgtcaagaggttaaataacgcaaagaacggcacagaagccgaatttgcttcagaagtcgagatactgggaagaataagacacaaaaacctcctgagcttccgtggatactgtgcggacggacccgagcgcgttctggtgtatgacttcatggcgaactcaagcctgtatgcgcatctccatggaccgcattccgcggagtgtctcctcgactggcggaggcgagcgtctatcgccatgggcaccgctcgggctctcttgtaccttcatcgccacgcaacgcctaagataatccacggaagcgtcaaggccaccaacgtgctgctggattcagacttccgggcgcacgctggcgatttcggtctggcaaggcttattcccgacgacggaacggaccacgaaaagatagccagcagcgagagccagcgaggctaccttgctcccgagtacgccgccatgtccggcaaaccaactgcaggctgcgatgtatacagcttcgggatcatactgctggagcttgcgagcggcagaaggccagtcgagaggtcgggttctggcaaggcttgtggaatccgaagctgggtgctcccgctcgcaaggcagggcaggtacgacgagattgcggactcgaagctgggcgacaagttctctggacctgagctgagaaggatggtgttggtcggtctagcgtgtacacgttcagaacctgaaaagagacccacgatgcttcaagtcgtgccgttgctgaaaggcgagtcgaaagaaacgcttgttaagcttgaaagggaggagttgttgttcagcccagactcgacgacggtgagttcgcagggaacaccgaccccagatgggagcacggactctgcgccgccgaagaaagatcaagaactggttggggcgtgagttgcgatatattgctgttctaggcgattgtagagtgcgtatttgtggtattgatgattggtatgtgcggtttgacgtgaatgggaattgtataggcattgttttttctaagttttttttctgtcccttttgagggagttaggaag

SEQ ID NO: 88 - protein, 375 aa, Zea mays
MHPKLPRAARRLLCCGGAAASPEEDLSDEGRRSLRWVFSLRELRSATNSFNYDNKIGEGPLGSVYWGQVWDGSQIAVKRLNNAKNGTEAEFASEVEILGRIRHKNLLSFRGYCADGPERVLVYDFMANSSLYAHLHGPHSAECLLDWRRRASIAMGTARALLYLHRHATPKIIHGSVKATNVLLDSDFRAHAGDFGLARLIPDDGTDHEKIASSESQRGYLAPEYAAMSGKPTAGCDVYSFGIILLELASGRRPVERSGSGKACGIRSWVLPLARQGRYDEIADSKLGDKFSGPELRRMVLVGLACTRSEPEKRPTMLQVVPLLKGESKETLVKLEREELLFSPDSTTVSSQGTPTPDGSTDSAPPKKDQELVGA

SEQ ID NO: 89 - DNA, 903 bp, Zea mays
gcgagctatcgcgcagcaggcacagcgccctacaacgcccggccgtgcaaactaaccttcggatcagatggagacgccggcggcggactcctccggcggcgaccgctacaggtcccacctggctggcgagggcgagaagcacaccgtgtggcggcacggcgcgccgccctcgtacgacgccgtgaacgcgctcttcgaggccgagcgcacgcaggagtggccggcggggtcgctggaggagatcgtgcagaacgcgatcaagacgtgggagatggagctgtcgcacaaggcgcggctgtcggacttcaagtccgtgagccccggcaggttcaggctgtccgtgaacggcgggcgggcccggagcggggaggagacgctggccgtgggcagctacaacgcgctgctggacagcccgctcctggcgcgcgcgggcgcgtacgacgcctccgccgagacgttccggtcctcgcacgacctgttccgcgccgcgttcccgcgcggcttcgcgtgggaggtgctcaaggtctactccggcccgccgctgctcgccttcaagttccggcactggggccacaaggaggggccctacaagggccacgccgccaccggcgacaaggtcgagttcttcggcgtcgccgtgcttaaggtggacgatgagctgcgggcggaagacgtggaggtatactacgacccgggcgagcttttgggaggccttctcaaggggcccaaggtggcttcctccgaggaggaccgccgcgaggccgctgccgtgtcggcgtcaggtgctgtcccgccgccgctagcttgcccctttctcaaccccgggaagccacagtgatcaaccagcaccccccatttatgtagcggtttggtgaataagtgaaagcttaaatgacggtgttc

SEQ ID NO: 90 - protein, 256 aa, Zea mays
METPAADSSGGDRYRSHLAGEGEKHTVWRHGAPPSYDAVNALFEAERTQEWPAGSLEEIVQNAIKTWEMELSHKARLSDFKSVSPGRFRLSVNGGRARSGEETLAVGSYNALLDSPLLARAGAYDASAETFRSSHDLFRAAFPRGFAWEVLKVYSGPPLLAFKFRHWGHKEGPYKGHAATGDKVEFFGVAVLKVDDELRAEDVEVYYDPGELLGGLLKGPKVASSEEDRREAAAVSASGAVPPPLACPFLNPGKPQ

SEQ ID NO: 91 - DNA, 2143 bp, Zea mays
gccagagagagatgcgggtgggagttgggatacctcggaggcggcgacgacaggatcgcagtggtcagtagccgggtcggccggtggccgcagattctcaccagcagcgccatccctcgccgtcgcccggcgctccagcccagggcaggagaggaggccactctgactgtcactctgagcttcgcgtcacctgagtactgacggacgacatgggagaagttgaggacatgtacacccaagacgggaccgtggacatgaaagggaatcccgccgtgaagaagggcaccggcaactggcgcgcctgcccctacatcctcgcgaacgagtgctgcgagaggctggcttactatggcatgagcaccaacctggtgaactacatgaagacccgacttggccaggtgaactccgttgcctccaacaacgtcaccaactggcaagggacgtgctacatcacgccgctcatcggcgccttcttcgccgacgcgtacatggggaggttctggaccatcgccatcttcatgatcatctacattttcggcctggcgctgctgacgatggcttcgtcggtgaaggggctggtgcctacgtcgtgcggcgacaaggatgtgtgccacccgacggacgcgcaggcggcggtggtgttcgtggcgctgtacctcatcgcgctgggcacgggcgggatcaagccgtgcgtgtcctccttcggcgccgaccagttcgacgagaacgacgagcgggagaagaagagcaagagctccttcttcaactggttctacttctccatcaacatcggcgcgctggtggcgtccacagtgctggtgtacgtgcagacgcacgtgggctggggctggggcttcggcatccccgccgtggtcatggccatcgccgtcggcagcttcttcgtgggcacgccgctgtacaggcaccagaagcccgggggcagcccgctgacgcgcatcgcgcaggtgctcgtcgcgtgcgcgcgcaagtggaacgtggccgtgcccgcggacaagtcgcggctgcacgagacggtggacggggagtccgtcatcgaggggagccgcaagctggagcactcggagcagctggcgtgcctcgacagggctgccgtggtgacggccgaggacggcgcggaggcgagcccgtggcgcctgtgctcggtgacgcaggtggaggagctcaagagcgtgatccggctgctgcccatctgggccagcgggatcgtgttcgcggcggtgtactcgcagatgagcaccatgttcgtgctgcagggtaacacgctggaccagagcatggggccccggttcaagatcccctcggcgacgctgtccatggtggacaccatcagcgtcatcgtctgggtccccgtgtacgaccgcgccatcgtgcccctggtgcgctcctacaccgggaggccgcgcgggttcacgcagctgcagcgcatgggcatcggcctcgtcgtctccatcttctccatggtggcggcgggcgtgctggacatcgtgcggctgcgcgccatcgcgcggcacggcctgtacggcgaggacgacatcgtgcccatctccatcttctggcagataccgcagtacttcatcatcgggtgcgcggaggtgttcaccttcgtggggcagctggagttcttctacgaccaggcgcccgacgccatgaggagcatgtgctccgcgctgtcgctcaccaccgtcgcgctcggcaactacctcagcacggtcctggtgaccatcgtcacccacatcaccaccaggcacggccgcatcgggtggatcccggagaacctcaaccgcggccacctcgactacttcttctggctgctcgccgtgctcagccttctcaacttccttgcctacctcgtcatcgccagctggtacaagtacaagaagacggccgatgattaccctggcgccaaaggggagcacggtacagagcactgatgggcgagagatggcggaaattgagtgatttctatgtgtggttagctgtctgcctgtctgtcgacttgttttgccacagtttgggtgcttaaacgttaacgtacgtactagttcaatatagtgtttgggggtgaattggttgtttacatgtcatgtgttggttttatatatgcgtaatgttcgatcttagt

SEQ ID NO: 92 - protein, 580 aa, Zea mays
MGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESVIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSIFSMVAAGVLDIVRLRAIARHGLYGEDDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEH

SEQ ID NO: 93 - DNA, 1628 bp, Zea mays
gcagcagccactcgctctccccacctcgtctctcttccactcatcccctccctcgccccttcgcctcgcctctcttcttcggatcgagcagcagtactgcactgcatgccgccgatacaaatcccatcctctccctcctctactgcacctgcaccacagtagctagctagctatctttgctacggcggctctgtaatctggtccactagcgctccattcgaccccacccacagccatggctgccgtgaccgcggcggccgtctctctgccctcctcctcctcctcccctgccgccgccaaggccaaggcgtccgcgtccgcgtccccgtcgtctccatgcggccacctccagttcccgcggcggcacggcggcccgcgcgcggtgcggctgcgcgtgcaggtgtccaccaccgagaccgcggaggcggagccggtcaagaagctggagaaggtgtccaagaagcaggaggaggggctcgtcaccaacaagtacaagcccaaggagccgtacgtcgggaggtgcctgctcaacaccaggatcaccggcgaccaagcgcccggggagacgtggcacatggtcttcagcacagaaggcgaggtcccctacagagagggccagtccatcggcgtcatcgcggatggcgaggacaagaacggcaagccgcacaagctcaggctctactccatcgccagcagcgccctcggagatttcggcgactccaagacggtgtcgctgtgcgtgaagaggctggtctacaccaacgatcagggggaggtcgtcaaaggagtctgctcgaacttcctctgtgacttgaagccaggcgctgaggtgaagatcacagggccagtgggcaaggagatgctcatgcccaaagaccccaacgcaacaatcatcatgctcgcaacgggtaccggcatcgctccgttccgctccttcttgtggaagatgttcttcgaggagcacgaggactacaagtacaccgggctggcgtggctgttcctgggcgtcccgaccagcgacaccctgctgtacaaggaggagctggagaagatgaaggagatggcgccggacaacttccggctggacttcgcggtgagccgggagcagacgaacgcggccggggagaagatgtacatccagacgcgcatggcggagtacaaggaggagctgtgggagctgctcaagaaggacaacacctacgtctacatgtgcgggctcaagggcatggagaagggcatcgacgacatcatgctcgacctcgcagccaaggacgggatcaactggttggactacaagaagcagctcaagaagagcgagcaatggaacgtcgaagtctactgatgatgatccttcattgtattgttcagctcaagcaatctggtggtgatgagtttgcattgcattgtacgtagtattgcggagatcaatcgaatcgtttggctcgtcgtcattctatcgatgtacatacattatatatgatgaaagacatatataatcgtttctttcaggaatttgttgtctctctgcacgtgaatttgttgcgagaaagaaaggacacacattagccttttctttattagggcaattatgaattatacccttctctgattctgattttacttttttc

SEQ ID NO: 94 - protein, 368 aa, Zea mays
MAAVTAAAVSLPSSSSSPAAAKAKASASASPSSPCGHLQFPRRHGGPRAVRLRVQVSTTETAEAEPVKKLEKVSKKQEEGLVTNKYKPKEPYVGRCLLNTRITGDQAPGETWHMVFSTEGEVPYREGQSIGVIADGEDKNGKPHKLRLYSIASSALGDFGDSKTVSLCVKRLVYTNDQGEVVKGVCSNFLCDLKPGAEVKITGPVGKEMLMPKDPNATIIMLATGTGIAPFRSFLWKMFFEEHEDYKYTGLAWLFLGVPTSDTLLYKEELEKMKEMAPDNFRLDFAVSREQTNAAGEKMYIQTRMAEYKEELWELLKKDNTYVYMCGLKGMEKGIDDIMLDLAAKDGINWLDYKKQLKKSEQWNVEVY

SEQ ID NO: 95 - DNA, 1721 bp, Zea mays
gcaccattcgtctcatcgccatttgaaccaggaatcttacgcggaaccgccccgcttccatggcgacggcatccactacgctgctcctctcccttgccttcctcgccttcgcctgggcggcgtcgccgtcgccgtcgccggatgcggaggcgatctcccggttccaggagtacctccgcatcgacacggcgcagccggcgccagactacgccgcggccgtggccttcctccggaaacaggccgccgatgctggactcgaggcgcgcacgcttgagctcgtcgccgggaagcccctgctgctgctgcggtggcccggtcggcggccgtcgctcccctccatactcctcaactcccacactgacgtggtgccgtcggagccgaacaagtgggaccacccgcccttttccgccgccctcgatgagccatccggtcgcatctacgcgcgaggctcccaggacatgaagtgtgtggggatgcagtaccttgaagccattcgccgtctccgttctgcaggatttgttccagatcgaaatatctatataacatttgttcctgacgaggagattggtgggcatggcggtgttgaaccatttgtttcatccaaggagttcaaagatatgaacgtggcattagtccttgatgaagggcttgcctctccaggggaggagtaccgtgtgttctatgcagagcgtagcccttggtggcttactataaaagcaacaggcgcaccagggcacggtgcgaagttgtatgatggtagtgcaatggagaatttgatgaagagcgtggaggctattaggagattcaggacatcacagtttgatctagtgaaatctggagagaaggctgaaggagatgttgtatcggtgaattttgcgtacctgaaggctggcacacctacaccaacgggttttgtcatgaatcttcaaccatctgaagcagaggtaggtcttgacatccggatccctcctagtgcccatgtggaagcactggagaggcgccttgttgaagaatgggcaccaccttcacgcaacctgaccttcgagtttaaacagaagatgtctgtcctggacaactttgggaagccagccatgacagcggcagacagcacaaacccatggtggacgttgctcgaagaagctgtgaagagcgctgacggcaaactcggcaagccggagatattcccagcctctactgacgctcgctacttccggaaaatcggattaccagcatttggcttttcacctatggcgaacaccccgatactgctccatgaccataacgagtttctgagcaaagacgagtacctcaagggaatcgggatatacgagtccatcatcagggcactggccactcatgaagatggcggcaaagatgacgaatccagggcagagctgtgagcctgtgactgaggagaaccttgaaccttacctcgcttttgccgcagaccaaatggagcactggaagtcatgtttcggcattatgcagctgcctgtgcttctgctgcggcgtcggagcgatagaaccacaaacatcatctttgtacattctcgcaagagggcttatgcgcttaataattgatgaaattgagatatgtagttcgtctgcgcagttcagggctcaccctgttgctacttgatgctgctttggcattggttgttgtatcaaaacttatatttacgttgcttcgtgcttcaaaaaaaaaaaaaaaaaaaaaaaaa

SEQ ID NO: 96 - protein, 446 aa, Zea mays
MATASTTLLLSLAFLAFAWAASPSPSPDAEAISRFQEYLRIDTAQPAPDYAAAVAFLRKQAADAGLEARTLELVAGKPLLLLRWPGRRPSLPSILLNSHTDVVPSEPNKWDHPPFSAALDEPSGRIYARGSQDMKCVGMQYLEAIRRLRSAGFVPDRNIYITFVPDEEIGGHGGVEPFVSSKEFKDMNVALVLDEGLASPGEEYRVFYAERSPWWLTIKATGAPGHGAKLYDGSAMENLMKSVEAIRRFRTSQFDLVKSGEKAEGDVVSVNFAYLKAGTPTPTGFVMNLQPSEAEVGLDIRIPPSAHVEALERRLVEEWAPPSRNLTFEFKQKMSVLDNFGKPAMTAADSTNPWWTLLEEAVKSADGKLGKPEIFPASTDARYFRKIGLPAFGFSPMANTPILLHDHNEFLSKDEYLKGIGIYESIIRALATHEDGGKDDESRAEL

SEQ ID NO: 97 - DNA, 1529 bp, Zea mays
gacgtggaggtgaagagatttatgtaggtccactagggctgcattcatgtgaactggtcaaatattttgagggcatcgaaggtgtcaacaagataggagatggctacaacccctcgacatggatgctagaagtgactagtacaatgcaagagcagataactggtattaacttcagtgaagtatacaagcattcagaactgcacaggaggaataaaactttgataaaggagctaagcacgcctccagaaggttcaagtgacctatcctttccaaccgaatactcacagactttcctcacacagtgtttggcttgtctatggaagcaaagcatgtcatattggagaaaccctccatatactggagtcaaatacttctacacgacagtgattgccctgttgtttggaacaatgttctggggtgtgggcagaaaaagggacagtcaacaggacctgttcaatgccattggctccatgtatgcctcggttattttcatgggagtgcagaattctggttcagttcagccagttgtatcggttgagcgaacagtcttttacagggaaagggcggctcatatgtactcgccattgccgtatgccttgggacaggtcgtaatcgaactcccatacatctttgttcagtccttaatatatggcgtgctggtgtatgctatgatcgggtttgaatggacagctgccaagttcttttggtacctgttcttcatgtatttcaccctagcatactacacgttctacgggatgatggtggtgggcctgactccgaactacaacgtctcctccgttgcttccacggcgttctatgccatctggaacctcttctcgggattcttaataccaagaactagaattccagtctggtggagatggttctactggatttgccccatcgcatggacgctcaacgggctggtcacttcacagtttggagatgtatccgagacgttcagtgacggtggggtgcgtatagctgacttcgttgaagactactttgggtaccatcacgacttgctgtgggtggtcgctgtggtggtggtcgcgtttcctgtgctctttgccttgctctttggtctctcgctcaagatattcaacttccagaagaggtaaataaaatgtgagacagcttgattaatcccaaggcgaaaatagcgcaggcgttgcggaagaaaggggggctgtattgtatgtaaatagcgtattcgttgatcagagcttctcaagctccagacaaattgtatagctgatagaggatcttgtacctgtttgtgtaaaattagccgataatgccttttttacgatggataaagtttagcttttgcaaagttttgtacatattggcacacactggatgttcgctgcaacactccaacgatgttttgaaaagatggatgtgtttactcgctgtagaaaatacggcgaccccaatagatttaaactgtgttgatcaagatgataacacatgtagtacagacgattagatgtccatgtcaaagtgtataaaaggattgactactt

SEQ ID NO: 98 - protein, 332 aa, Zea mays
MLEVTSTMQEQITGINFSEVYKHSELHRRNKTLIKELSTPPEGSSDLSFPTEYSQTFLTQCLACLWKQSMSYWRNPPYTGVKYFYTTVIALLFGTMFWGVGRKRDSQQDLFNAIGSMYASVIFMGVQNSGSVQPVVSVERTVFYRERAAHMYSPLPYALGQVVIELPYIFVQSLIYGVLVYAMIGFEWTAAKFFWYLFFMYFTLAYYTFYGMMVVGLTPNYNVSSVASTAFYAIWNLFSGFLIPRTRIPVWWRWFYWICPIAWTLNGLVTSQFGDVSETFSDGGVRIADFVEDYFGYHHDLLWVVAVVVVAFPVLFALLFGLSLKIFNFQKR

SEQ ID NO: 99 - DNA, 1687 bp, Zea mays
cttcaaactaccccagttatccggcgcggttccttgcttgtgtcgagcagagatcacaaaaccaagaaacagctgaggcgccgcgcgcggaggtagctgcctgaactaatcggtgtcgcaatggctgcaacgagtatgatcagggcgccgattgggccgaacccgaggctcgcgtgctacgccccggcgaggggcggcggcgtggtcaggtgctcgttgcagggcgcggtcgtcggcggccgggcggagtggcagagcagctgcgccatgctgtccagcaaggtggctgcgctcgggacgcactccatcaacggccacgtcgcgccggcgccggcgccggcgccagcggtgctggatttggtccccgtgagtagtatgaatggcgccgtggctaagaacctgccgcagccgcttcgcatcgcggacctgtcccctgcgccgatgcacgggtcggagctacgcgtggcttaccagggcgtgcccggcgcgtacagcgagaaggcggccgggaaggcgtacccgggctgcgacgccatcccctgcgaccagttcgaggtggcgttccaggccgtggagctgtggattgccgaccgcgccgtgctccccgtggagaactcgctgggcggcagcatccaccgcaactacgacctgcgagttctccggcaccggctccacatcgtcggggaggtgcagctccccgtgcaccactggctgctggcgctgcccggggtgcgcaaggagtgcctgacccgcgtgatgagccacccgcaggcgctggcgcagtgcgagcacacgctcacggccatgggcctcaacgtcgtccgcgaggccttcgacgacacggccggcgccgccgagtacgtggccgccaacggcctccgcgacacggccgccatcgcgtcctcccgcgccgccgagctgtacgggatggaggtgctggcggacggcatccaggacgactccggcaacgtcacccgcttcgtgatgctggcccgggagcccgtcgtgccgcgcaccgaccgccccttcaagaccagcatcgtgttcgcgcacgacagggagggcacctccgtgctcttcaaggtgctctccgccttcgccttccgcgacatctcgctcaccaagatcgagagcaggccgcaccgccaccgccccatccgcctcgtcgacgacgccaacgtcggcaccgccaagcacttcgagtacatgttctacgtcgacttccaggcgtccctcgcagagccccgcgcgcagaacgcgctggccgaggtccaggagtacacgtccttcctccgggtgctcgggagctaccccatggacatgacccccatgaccgccggctcctcctccaccgttgtttcctcgtccgatgatccctcgtcgtcttgattgccgttggaggctggagctagctccgaggagaagtcgtcgagtagggacgttggttttctgctcatgtcgtcctactcgatcgcccctcgctgcagccggagtaattaattttgagtttcctttaatctttcatggtaatagtattatgtacgtgtaattgttcaaaatcatccgcggtgaatatatctgtgaaacagtactagatgacattcatattcatctgttgtcggaaactctgaacactttccagtactactagcagttgctatgaaaaagaagaaggttaaattaaagg

SEQ ID NO: 100 - protein, 422 aa, Zea mays
MAATSMIRAPIGPNPRLACYAPARGGGVVRCSLQGAVVGGRAEWQSSCAMLSSKVAALGTHSINGHVAPAPAPAPAVLDLVPVSSMNGAVAKNLPQPLRIADLSPAPMHGSELRVAYQGVPGAYSEKAAGKAYPGCDAIPCDQFEVAFQAVELWIADRAVLPVENSLGGSIHRNYDLRVLRHRLHIVGEVQLPVHHWLLALPGVRKECLTRVMSHPQALAQCEHTLTAMGLNVVREAFDDTAGAAEYVAANGLRDTAAIASSRAAELYGMEVLADGIQDDSGNVTRFVMLAREPVVPRTDRPFKTSIVFAHDREGTSVLFKVLSAFAFRDISLTKIESRPHRHRPIRLVDDANVGTAKHFEYMFYVDFQASLAEPRAQNALAEVQEYTSFLRVLGSYPMDMTPMTAGSSSTVVSSSDDPSSS

SEQ ID NO: 101 - DNA, 2001 bp, Zea mays
caccaaacactcccgcagacccacagccccgcccgtccccgtccgtccacagccagctccgcctcccatccagcgcccgtccacagccgccgcagttccagtgagatcgagcgaggtaagcttagatctgagcgatttctctcgcgcgtcgcaggtaaagttcactcgacttcgactctctcatcctcttctgttcttcctggttccgtcttcttcctcgagcagacagcgagagacccgtggccttttagatcccgggcttcagatctgctgtttcttcttcggtttggttctagttctagcagtgtactagtactagtcgttaggttggtagccaagagaggttctttttccacacctcccttgcgcaagtgagtcctgtcctgagtggatctacccaccactgccatctgtttttactgtggctgttgggttccgccagtttcttcgtttgttcttggtttgctagagagagaggaaaaaaaacaaaaaaacaaaaaaaaacagtctagatggctgctactatagatctgtcaggggaggagctgatgagagcactcgagccttttatccgggatgcctctgctcacggatccagtccgctcctccacccgcaccagccacttagcccctcgtcgccgttctccttccaccaagccgtcgccgccgcctcctcctacggagggaactacccgttcgccgcggccgacgaggcgggccagctgagcccttcccagatgcagtacatccaggcccgcctccacctgcagcgtcgccaggcgcagacctccgtgctgggcccgcgtgcccagcccatgaaggcgtcggcgtccgcggcccccgccccggcgcggccgcagaagctgtaccgcggcgtgcggcagcggcactggggcaagtgggtggcggagatccggctcccgcgcaaccgcacccggctctggctcggcaccttcgacaccgccgaggaggcggcgctggcctacgaccaggccgcctaccgcctccgcggcgacgcggcgcgcctcaacttccccgacaacgccgcctcccgcggcccgctccacgcctccgtcgacgccaagctccagagcctgtgccagagcatcgccgcgtccaagaagggcgccaagaagccggcctccgccgcagctgccgcgtcgtcgtccgcccccaccagcaactgctgctcctcgccgtcgtccgacgacgcgacctcgtcctgcctcgagtccgccaccgagtcctcgtgcccgtccccgtcgccgtccgcctcgccagggccgacggtgccggagatgcagcagctggacttcagcgaggcgccgtgggacgaggccgccggcttcgcgctcaccaagtacccgtcgtacgagatcgactgggactccctcctcgccaattaatcgtcgccccttgttggctggctggctggctggctcccatcctacccacactgccgtcgtgcagcaggaggagggttaaagaaggttaacggccgtcgcgcagatgggattttagacatcctgcgcgggcactagttggatcattagtgctaatccccgtccgtccgttcgttggttggttctgtgtagatgtccgtccgattcgtttggtccttgtcactggtgagtcagttgtagatctcgggttatttagggtttggttctccggaggaggagagaaccacaaccgacgggaagccggcgtttttgtgtccggcgttctccggtggtggccggtacgtgtcacactggtcagtgaccccacccccccggccgttcaggtgtccgttgtcctggtagctgtttttgttgtgctagatggtgtgctgtgctctacaggttgtaaagagcagcacggtgtgatgtgaggagatgcttgtcaagcagtagtgctccgtatgatgtatgttgtaaaatcagctagctagctgtgtccaggagttgtaatttgatgaactgctactgttggtgctactattgtatggtttattgttgt

SEQ ID NO: 102 - protein, 297 aa, Zea mays
MAATIDLSGEELMRALEPFIRDASAHGSSPLLHPHQPLSPSSPFSFHQAVAAASSYGGNYPFAAADEAGQLSPSQMQYIQARLHLQRRQAQTSVLGPRAQPMKASASAAPAPARPQKLYRGVRQRHWGKWVAEIRLPRNRTRLWLGTFDTAEEAALAYDQAAYRLRGDAARLNFPDNAASRGPLHASVDAKLQSLCQSIAASKKGAKKPASAAAAASSSAPTSNCCSSPSSDDATSSCLESATESSCPSPSPSASPGPTVPEMQQLDFSEAPWDEAAGFALTKYPSYEIDWDSLLAN

SEQ ID NO: 103 - DNA, 2126 bp, Zea mays
attccactacctcccaaactcgcgagcgagtcgaggctccaaccccggcacatcacaggaggaggaggacgacgcgcccaccatggccatggcgacggccctccgcaagctctccgccaacgctctgcgccgccagccgctctcccgcatcacgccgctctactacatggcgtcccttccggcgacggaggagagatccggaatcacctggactaagcagttgaacgcgccgctggaagaggtcgaccccgagattgctgacatcatcgagcacgagaaggcccgccaatggaagggtctggagctcatcccgtcggagaatttcacgtcggtgtcagtgatgcaggcagtgggttccgtcatgaccaacaagtacagcgaggggtaccctggcgcaagatactacgggggaaatgagtttattgatatggcagagtccttgtgtcagaaacgtgctttggaggctttccgtttggacccggcgaaatggggagtgaatgtgcaacctctatccggttcgcccgccaacttccatgtatacactgcactcttgaagccacatgaaaggatcatggctttggatcttcctcacggtggacatctttctcatggttaccagactgacactaagaagatatctgcaacttcaatattttttgagacaatgccttacagattggatgaaagcactggattgattgattacgatcagttggagaaaagcgctgttctttttaggccaaagttgatcattgctggtgcaagtgcatatgctcggctatatgattatgaccgtatgcggaagatatgcaacaagcagaaggcaatacttctagcagacatggcacatattagtgggcttgttgcagctggtgttgttccatctccttttgattatgcagatgtagtgactaccactactcacaaatcactccgtgggccacgtggagccatgatcttttacaggaagggagtcaaagaaataaataaacaaggaaaagaggttatgtatgattttgaggacaaaatcaatgctgctgtctttcctggtctgcaaggtgggcctcataaccataccattactggcttggctgttgcgctcaaacaggcaactactccagaatacagagcttaccaagagcaagttatcagtaattgtgctaaatttgcgcagagcctgatttcaaaaggatatgaactcgtctctggtgggactgacaaccatttagttctggtgaatctcaagaataaggggatagatggttcaagggtggagaaggttttagaaagtgtgcatattgcagcaaacaagaacacagttcctggtgatgtttcagctatggtgccaggaggcatcaggatgggaaccccagcccttacgtcgagaggatttgttgaagaagatttcgctaaagttgctgacttcttcgatgcagcagtgaatctggccttgaagattaaggctgcaacgacaggtggaacaaagctgaaggactttgttgccactttgcaatctgatagcatccaagttgagattgcaaagcttcgccatgatgtagaggaatttgcaaaacaattcccaacaattggatttgagaaagagaccatgaaatacaagaactaatatctggatgacaagaagagaatgaggtcactcttcttgcagtaagcattcgaagcaagatgccacgatgattattgggagtttaaccatggtgtaatggcatcttatgttaaagagatgttggcaatttacagcatgtggaactttcgtcaatcatattgtagacacataccgcgagatgctatattgaccggacaattgcatttccatatgtgtacatcctttaaaaaaaaaaaaaaaaaaacgtacatcctgacacacactccacccccatccccactcacaagcacacgtcaccctgcccgcaaggctatctactcatctctataatcaaactatactatgtgaaagttatagtctacgggaatagtgcaaaatagtgttttagatgactatgtggataaactaatgaagacagtataactatatgtacaacctcatttaaaaggtctctaagagattaattaaaaaaatacgagacaagctcttcgttagaagtgtc

SEQ ID NO: 104 - protein, 513 aa, Zea mays
MAMATALRKLSANALRRQPLSRITPLYYMASLPATEERSGITWTKQLNAPLEEVDPEIADIIEHEKARQWKGLELIPSENFTSVSVMQAVGSVMTNKYSEGYPGARYYGGNEFIDMAESLCQKRALEAFRLDPAKWGVNVQPLSGSPANFHVYTALLKPHERIMALDLPHGGHLSHGYQTDTKKISATSIFFETMPYRLDESTGLIDYDQLEKSAVLFRPKLIIAGASAYARLYDYDRMRKICNKQKAILLADMAHISGLVAAGVVPSPFDYADVVTTTTHKSLRGPRGAMIFYRKGVKEINKQGKEVMYDFEDKINAAVFPGLQGGPHNHTITGLAVALKQATTPEYRAYQEQVISNCAKFAQSLISKGYELVSGGTDNHLVLVNLKNKGIDGSRVEKVLESVHIAANKNTVPGDVSAMVPGGIRMGTPALTSRGFVEEDFAKVADFFDAAVNLALKIKAATTGGTKLKDFVATLQSDSIQVEIAKLRHDVEEFAKQFPTIGFEKETMKYKN

SEQ ID NO: 105 - DNA, 1907 bp, Zea mays
aacaccactccactgactccgccctggctctctctccttccatcggcctccgcggctccgccccctcccccttccattttaaatttcaaacccctcccacctgcttcctcctcctctcccctgctgccacgaggcgcggctcagctcctcctcgaagcgggcggggaatccaggccgcgcggcggcggggcggaggaggaggaggagcgggggatgatggggtgcctcttcggctgcttccgcgcgtccggcgacggcggcgatgcgaagggcgccggagaccgcaacacgtccctggcccccgcgacgacgacgacgatccaacaggatggtacgggcaggaggatcaggccaccgtcgaggaacgcgctctccgccgtgttccagcgagaagatgagggatcgagggcggcgcaggcggcgagctcgtgggcggaacagactggtgagagcaagaggatggatcaggagcttgagccccagaccattatccaaaaaaactgtggtgcattgctgcaaactacaaacaacatccaaagtgtgctcagagatgcagattcagttcatcagaaggaaacacattcaggatgtcttcctgttatgtctgatgatgtacatttcatggaagcgccaaaggttgagaactgtgaaactcctccaaggtctcatcagagctccactgtaccagatgcaacgagttcttcaaaaacaaatgatgagttgcgtacttccgctacttccttaaaaaataacgtggaagagtcaacaaatgagaacgatactgaggcctgtgtgcagggtgaagaacaacaacaagctctggatcttgctgaggattttgaagaatgtggggtttcaaaagaagatttcttcccccctgaaaaattagaggatccaaagtgtgcaaagaatgaccatgtggtctccatggaaatttcaatatccgatgaatgttcccttttccagagctctgagggttctgtatcaccttctaacaagataagagggagcatgaatacaacatctacggagaagtcaccgaaaactgaggcaactattcatgccaccagaaagaagttactgaagagcaatacttcagaactggagctcccaagcttagctcaatggttgaagcctccaaatcctaagaaagcattcagagatgaggctgtgacaggagacagatctcattcagctaagagttcagatgaggataggcctattattggaatggttgcagcacactggaaagataaagagccagcaaatttcacctctaaatggtgggatggaaatggcattcccaattcaacaaataagtacaaagaagaccaaaaggtgagctggcatgcaacaccatttgaggagaggcttgagaaggctttatctgaagagaagtcgctctctgaaaggaactgctcgagtggaaaaacatctcagtttttaggagtggaaggcgaggagagtgatactgctggatctaaccgtctatatgctactgcttatgcatgacaattctgctagccacgaggcacagaagctttcagtacaatggttttctgctatcaccctcctgattgattgcatttgcacagccctgttttcctctgtcctagagtaggtagcatccggatgtgatgtttcagtttgtgcttacctcaactgtttaagatataattaactctaatactgttgctgacacgggatggcataataacaggcagccaaaattgagagtggcaaaatagcaaatttctctcctgatttgatggcatttgcacagccctgtttccctctgtcctagagtaggtagcatccggatgtgatgtttcagtttgtgcttacctcaactgtttaagataattaactttaatactgttgctgcctcagttgacaatataaaataa

SEQ ID NO: 106 - protein, 432 aa, Zea mays
MMGCLFGCFRASGDGGDAKGAGDRNTSLAPATTTTIQQDGTGRRIRPPSRNALSAVFQREDEGSRAAQAASSWAEQTGESKRMDQELEPQTIIQKNCGALLQTTNNIQSVLRDADSVHQKETHSGCLPVMSDDVHFMEAPKVENCETPPRSHQSSTVPDATSSSKTNDELRTSATSLKNNVEESTNENDTEACVQGEEQQQALDLAEDFEECGVSKEDFFPPEKLEDPKCAKNDHVVSMEISISDECSLFQSSEGSVSPSNKIRGSMNTTSTEKSPKTEATIHATRKKLLKSNTSELELPSLAQWLKPPNPKKAFRDEAVTGDRSHSAKSSDEDRPIIGMVAAHWKDKEPANFTSKWWDGNGIPNSTNKYKEDQKVSWHATPFEERLEKALSEEKSLSERNCSSGKTSQFLGVEGEESDTAGSNRLYATAYA

SEQ ID NO: 107 - DNA, 1649 bp, Zea mays
cgaatcccgagcacaggccgccgctcgctcgctcgctgcagctacgcacgcacgcgcctgctcctccccttagcttccacaaggctcgactcggccggcggcgatggcgcggaagaagatccgggagtacgactccaagcgcctcctccgggagcacctcaagcgcctcgccggcatcgacctccagatcctctccgcgcaggtcacacagtcaacggatttcactgagcttgcaaaccaggagccgtggctctcatctatgaagttggttgtgaaacctgacatgctctttgggaaacgtgggaagagtgggcttgtggccctcaacctagatcttgcccaagttcgccaatttgtcaaggagcggttgggagttgaggtcgagatgggtggctgcaaagctccaattacaaccttcatagttgaaccatttgtgccacatgaccaagagtactacctttcgattgtatctgaaaggcttggcaacaccattagtttctcagaatgtggaggtattgagatcgaggagaactgggacaaggttaagactatctttcttcccacagagaagcaaatgacacctgacgcatgtgctccattgattgccaccctgccattggaggtccgcacaaagataggtggtttcattagagctgtattttctgttttccaagacttggatttctcatttcttgagatgaacccattcaccttggtaaatggtgaaccgtatcctctggatatgagaggagaactagatgacacagctgctttcaaaaacttcaataagtggggcaatattgtgtttcccctaccatttggaagagttctcagtccctccgaaagttttatccatgaactggatgagaagacaagtgcttctctgaaattcacggtactgaacccaaaaggacgcatctggacaatggttgcaggtggtggtgctagtgtcatatacgcagacactgttggtgatttgggatatgcttcggagctaggaaattatgcagagtacagtggagctcccaaggaggaggaggttctgcagtatgctagagtgcttttggattgcgctacctctgatcctgatggccgtaagagagcccttctaatcggaggaggaatcgctaacttcacagatgttgcttctacatttagtggcatcattcgggctttaagagagaaggagtccaaattaaaggctgcaaggatgaacatttatgtccggagaggtggtccgaactaccaaactggactcgccaaaatgcgcaccctaggcgccgaacttggcgttccaattgaggtctatggaccagaggcgaccatgactgggatctgcaaagaagccattgattgcatcatggccgcgtaaatcacaaatgtggttgttccatttgaagtcacatccgttttgtactagacgttccttgtacgtgattgctctggtaaaacagagaacgatcattgtcatgagtaaactcggcctttgtaacacagttacgcaagtaataattaagatcttggtttggtgctctgccacccttctagggtgggccggtgaggtgaatgtacaaataacaatgcactttgtgatccaccagattgcagtgctctggtatttctaaaaaaaaaaaaaaaaaaaaaaaaaa

SEQ ID NO: 108 - protein, 420 aa, Zea mays
MARKKIREYDSKRLLREHLKRLAGIDLQILSAQVTQSTDFTELANQEPWLSSMKLVVKPDMLFGKRGKSGLVALNLDLAQVRQFVKERLGVEVEMGGCKAPITTFIVEPFVPHDQEYYLSIVSERLGNTISFSECGGIEIEENWDKVKTIFLPTEKQMTPDACAPLIATLPLEVRTKIGGFIRAVFSVFQDLDFSFLEMNPFTLVNGEPYPLDMRGELDDTAAFKNFNKWGNIVFPLPFGRVLSPSESFIHELDEKTSASLKFTVLNPKGRIWTMVAGGGASVIYADTVGDLGYASELGNYAEYSGAPKEEEVLQYARVLLDCATSDPDGRKRALLIGGGIANFTDVASTFSGIIRALREKESKLKAARMNIYVRRGGPNYQTGLAKMRTLGAELGVPIEVYGPEATMTGICKEAIDCIM

SEQ ID NO: 109 - DNA, 1712 bp, Zea mays
cgcagtaggcaggcccgacctcctgcccttgtacaacgcacgcacggtccccgtcccaatggcccagactctgtccgccgcctccgagctggccaccctgaagcgcccgttcggcaacgacgggttcggcgatggcagcaacaacggcagcgccaccggcgagaagcccaaggcgcggcggcgggaggcggacccggcggcggcgctggccgcggcgcggcacgagttcggcgagcacggcggcgtgaacatgtccatcgaggcgtcggcgacgttcacggtgatggagccggacacgatgcggcggctgttcgcgggcgagctgggccccgaccgcggcgacatgtacatctacagccggcacttcaacccgacggtgctggcgctggggcggcagatggcggcgctggagggcacggaggcgggctactgcacggcgtccgggatgtccgccatctcgtccgtgctgatgcagctggtgggcgccggcgggcacgtggtggcgtcgcggtgcctgtacggcgggacacacgcgctgctggcccggttcctgccgcgcgcctccggggtgcgcgccaccttcgtggacgccgacgacgaggccgccgtgcgcgccgcggtggtccccggcgagacgcgggtggtgtacgtggagaccatgtccaacccgacgctcgccgtcgccgacatccccatgctggcgcgggtggcgcacgaggccggcgccaagctcgtggtggacaacaccttcacccccgtggtggtgtcgcccgcgcgcctcggcgccgacgtcgtcgtccacagcgtctccaagttcatcagcggcggcgccgacatcatcgccggcgcgatctgcgggccggcgagcctggtgaacgcgatgatggacctgcaggagggggcgctgatgctgctgggccccacgatgaacgccaaggtggcgttcgagctgtcggagcggctgccgcacctgccgctgcggatgcaggagcactcgcgccgcgcgctggcgttcgccgagcggatgcaggggctgggcctgcgcgtgctgtacccgggcctcccgggccacccgcaccacgcgcgcctggccgccatgggcaacccgggctacggctgcggcggcatgctgtgcctcgacatgggcaccgaggagcgcgccaaccgcctcatgcaccacctccagaacaccacccagttcggcctcatggccgtcagcctcggctactacgagacgctcatgtcctgctccggcagcagcaccagcagcgagatgccgcccgaggaccgcgcgcgcgcgggcatctccccgggcctcgtccgcatgtccgtcggctacaacggcacgctggagcagcgctgggcgcagttcgagcgcgcgctcgcgctcatgcagacgccgacgcccacgcaccacctcaagcaggccgccgaccgcgacggccccgaagccgccaacaaccaccaccgcaagcactgacgcgcttgcgcttccgagcgtgcgtgcgtgcatgcatggcctgtggacttgtgtttgtcgtgttcgtgtatatactactagtgccattcaagcaagaatattaaacaccatctgatccctctggttcagatggatcgatatgccagtgcaagcggctcgatctctggggaacctgggaatggacctgaataaatgggatttgtctttaaaaaaaaaaaaaaaaaaaaaaaaa

SEQ ID NO: 110 - protein, 466 aa, Zea mays
MAQTLSAASELATLKRPFGNDGFGDGSNNGSATGEKPKARRREADPAAALAAARHEFGEHGGVNMSIEASATFTVMEPDTMRRLFAGELGPDRGDMYIYSRHFNPTVLALGRQMAALEGTEAGYCTASGMSAISSVLMQLVGAGGHVVASRCLYGGTHALLARFLPRASGVRATFVDADDEAAVRAAVVPGETRVVYVETMSNPTLAVADIPMLARVAHEAGAKLVVDNTFTPVVVSPARLGADVVVHSVSKFISGGADIIAGAICGPASLVNAMMDLQEGALMLLGPTMNAKVAFELSERLPHLPLRMQEHSRRALAFAERMQGLGLRVLYPGLPGHPHHARLAAMGNPGYGCGGMLCLDMGTEERANRLMHHLQNTTQFGLMAVSLGYYETLMSCSGSSTSSEMPPEDRARAGISPGLVRMSVGYNGTLEQRWAQFERALALMQTPTPTHHLKQAADRDGPEAA

SEQ ID NO: 111 - DNA, 1154 bp, Zea mays
gagagagagagagagagagagagagagagagagagagagagagagagagagagagagagagagagagagggggggggagagaggatggctttgctgcagagccagagcctgccaggcattggctgctgcagcagcagcatcgtcttggcacgagcgagggtgcagcagtgtctggcagcggcgtcgcactcacaggcgcccctcctgcaggccaatggcggcagggcgggcctcccctcctcctcctcgatccttaaggctggcaatgcgatcagcttcagccggcggagaaggagatacctgcgcgtcgtcgcggaggcggccacggcggggacggccaaggtcacgccggcctcgtctggcggcgtcagcctcagcgacgtgctctggccttctgccggagcattcctggccatggcggtactggggaaaatggaccagatggtggcgttcaagggagtatccttgacgattgcgccccttggagcagtctgctgcgtgcttttcagcgctccagactcgcctgcggccaagaaatacaatatgttcgtcgcgcagattgcttgcgcggcctttggcgtattagccctctcgttgtttgggcctggctggttagcgagaggcgccgctctttcagcctgcatagcattcatgaccatcacgggtacctcgcatcctccagctgcgagcttgcccctcttgtttatcgatggccccaagtttcacagtttgcagctttggtacgcgcttttccctggagctgcaggctgcatcgtcctttgcttgattcaagaggtggtggtttacctgaagaagaacttcaaattttgactcaagcagcttgacgctatggatttttgtggaagtggtccgattaattattcaatcatgtaacataaattacattgcctgcatttgcgataaagttgtgaaaatgaaggtttactgtctcctgtcttggttaaagaagaaagaagactttccttgataccttgtgctcatcaaaatgcagttgatacaaatgtgtacataccattctcccatcgaataaagtctgacaatttattcctttttccttctggtagcatcaatcctgtaatgtaattgtgcaaagtgaaataaccaggaatactttgtgataaaaaaaaaaaaaa

SEQ ID NO: 112 - protein, 237 aa, Zea mays
MALLQSQSLPGIGCCSSSIVLARARVQQCLAAASHSQAPLLQANGGRAGLPSSSSILKAGNAISFSRRRRRYLRVVAEAATAGTAKVTPASSGGVSLSDVLWPSAGAFLAMAVLGKMDQMVAFKGVSLTIAPLGAVCCVLFSAPDSPAAKKYNMFVAQIACAAFGVLALSLFGPGWLARGAALSACIAFMTITGTSHPPAASLPLLFIDGPKFHSLQLWYALFPGAAGCIVLCLIQE

SEQ ID NO: 113 - DNA, 1536 bp, Zea mays
gtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggtatcatagagagtgttggagagggtgtgactgacgtagctccgggcgaccatgtccttcctgtgttcactggggagtgcaaggagtgtgcccactgcaagtcggcagagagcaacatgtgtgatctgctcaggatcaacaccgaccgcggtgtgatgattgccgatggcaagtcgcggttttcaatcaatgggaagcctatctaccactttgttgggacttccaccttcagcgagtacaccgtcatgcatgtgggttgtgttgcaaagatcaaccctcaggctccccttgataaagtttgcgtccttagctgtggtatttctaccggtcttggtgcatcaattaatgttgcaaaacctccgaagggttcgacagtggctgttttcggtttaggagccgttggtcttgccgctgcagaaggtgcaaggattgctggagcgtcaaggatcattggtgtcgacctgaaccccagcagattcgaagaagctaggaagttcggttgcactgaatttgtgaacccaaaagaccacaacaagccagtgcaggaggtacttgctgagatgaccaacggaggggtcgaccgcagtgtggaatgcactggcaacattaatgctatgatccaagctttcgaatgtgttcatgatggctggggtgttgctgtgctggtgggtgtgccacataaggacgctgagttcaagacccacccgatgaacttcctgaacgaaaggaccctgaaggggaccttctttggcaactataagccacgcactgatctgccaaatgtggtggagctgtacatgaaaaaggagctggaggtggagaagttcatcacgcacagcgtcccgttcgccgagatcaacaaggcgttcgacctgatggccaagggggagggcatccgctgcatcatccgcatggagaactagatttcgctgtctagtttgtgatctggcctgggcttggggttaataaaagaggcaatgctagcctgccctttcgatgaggaggtacatacacgctggcgatggaccgcgcttgtgtgtcgcgttcagtttggcttttgccaagcagtagggtagcttcccgtgtcggtaattatatggtatgaaccatcaccttttggctctacatggtatgaacgtaagatacaaattccaactacctctagctcgcttgtgtggtatctgtatcagtattcatgtgtttgtttgcttatgtgtttgtttgcttgtaaaaaaaaaaaaaaaa

SEQ ID NO: 114 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 115 - DNA, 818 bp, Zea mays
  misc_feature 796, 799: n = A,T,C or G
ggggctagcccgccgcgcagcagccacaaattaaacggagcccggcctgggcatccattattcgttgcagtagtcgcagctgacggacgactgaaccaccgacagacaacatggccgcctccgcctccaccgtctccggcctcgccggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatcggccaggagctggcccacttccccacgcccccgcccgtcacctcccagttctggctgtggctagtgacgtggcacctgggcctgttcatcgtgctcaccttcggccagatcggattcaagggcaggaccgaggactacttcgagaagtgaagcggttaagatcctatccatcatccctggtgctgcgctgcgttgcgttgcgtgcgtgctcgccgctatcgaacctttgctgtatagggttccgatttcgtcgaatgtaatgtatgatgctacttttgagcttcaatgtaaaatctatgccgtccggccccaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaanaaaaaaaaaaaaaaaaaaa

SEQ ID NO: 116 - protein, 144 aa, Zea mays
MAASASTVSGLAGASLASRPAFSTSFTRGSRVSARNPLMSRNLERNGRITCMTFPRDWLRRDLSVIGFGLIGWMGPSSVPAINGNSLTGLFFSSIGQELAHFPTPPPVTSQFWLWLVTWHLGLFIVLTFGQIGFKGRTEDYFEK

SEQ ID NO: 117 - DNA, 2086 bp, Zea mays
agcgatccatccccccgagccgtgccaaccaagaaccatccacccaccaccaccaccccggccgcttccttgtccctgcccctccgttggtctcctttgcccatctcatcctctctcgctcgcgcgggcggtcggcgtggctccgggggcgcgaagcgcgggctcggcggggcgactcgccggcggcgacctgcaggtttgggtatgagaggggtcacccacgcggcgcccaccacaagcgccccccgcccccgcggacgcctcatggacggcctcctcatcttcgtcttctacctctcgctgcccacccgtgccggccgcgaccactcgtccatcgccgcctctaattgttagccgccgccggcacgccattgctcggcccgcctcccgagaagctcgatctgcggcctacgcacgcgcgccgccaccgtcgccagccagcctcacacgcacgggatcaggatcgatggaccagccaccgaatggattcgccgctggaggttttttcacgcacattgatgggcaaaaccgttctcccccttctataattgtcattgggggagggatttcaggcatcgcagctgcacgtgctttgtcgactgcttcatttaatgtcacactcttggagtccagggaccgacttggtggccgtgtgcacactgactattctttcggttgcccaattgacatgggagcatcatggttgcatggtgtttgcaatgagaattctttggcaccactgattaggatgcttgggcttaggttatatcgcacaagcggtgataactctgttctgtatgaccatgatttggaaagttatgctctttttgataagcatggtcagcaagttccccaggagatagtaagcaaagttggagagacatttgagagaattcttaaggagactgtcatagtaagagatgagcatgcaaatgacatgcctctttttcaagccatagggatcgtgcttgacaggaatccgcatatgaagctgcagggcctggaatatgaagtactgcagtggtgcatatgtaggctggaggcatggttcgctactgacatggacaatatatctctgaaaacttgggatcaggaacatgtgcttaccggcggacatggtcttatggtgaatggctacgaccctgtcatcagagctctcgctcaaggtctagatattcacctgaaccacagggtcacaaagatcatacaacgctataacaaggttattgtctgtgtggaagacggggcgagttttgtcgcagacgctgctatagtaaccgtccctctcggggtactcaaggcaaacatcatcaagtttgagcctgagctaccgaaagagaagctctcggcaatcgccgaccttggcgtcggtatcgagaacaagatagctctcaagttcgacactgtgttttggcccgacgttgaagtgataggtagggtggccccgacgtcaaacgcctgtggctactttctcaaccttaacaaagccacaggaaacccggtcctggtgtgcatggtggccggaaggttcgcgtacgagatcgagaagctgtcggacgaagagtccgtgaacttcgtcatgtcccaactcaggaacatgctgccgcaggcaactgacccggttcagtatctggtctcgcgctggggtagtgaccccaactcacttggctcctactcgtgcgacctggtggggaaaccagctgacctgtatgaaaggttctgcgctccggttggcagcctgttcttcgccggggaggctgcctgcattgaccactccggatcggtgcacggagcttactcgtcaggcatcgctgccgcagaggactgccgaaggcgtctgtcggcgcagctaggcatctcggccggcctgttccaggtcgggaaggctgccatgagggaggagatgacggctgaagccatggtccccttccagatatccaggctgtaagagagaatctattcgacaccgtctttgtgtcaccggtttgttgcttgctgtaattgtaaaatggtgtaagaccttgtttgttggaaaattcgatggtggatgctgtttttcgtcaggtaaaaaaaaaaaaaaaaaaaa

SEQ ID NO: 118 - protein, 493 aa, Zea mays
MDQPPNGFAAGGFFTHIDGQNRSPPSIIVIGGGISGIAAARALSTASFNVTLLESRDRLGGRVHTDYSFGCPIDMGASWLHGVCNENSLAPLIRMLGLRLYRTSGDNSVLYDHDLESYALFDKHGQQVPQEIVSKVGETFERILKETVIVRDEHANDMPLFQAIGIVLDRNPHMKLQGLEYEVLQWCICRLEAWFATDMDNISLKTWDQEHVLTGGHGLMVNGYDPVIRALAQGLDIHLNHRVTKIIQRYNKVIVCVEDGASFVADAAIVTVPLGVLKANIIKFEPELPKEKLSAIADLGVGIENKIALKFDTVFWPDVEVIGRVAPTSNACGYFLNLNKATGNPVLVCMVAGRFAYEIEKLSDEESVNFVMSQLRNMLPQATDPVQYLVSRWGSDPNSLGSYSCDLVGKPADLYERFCAPVGSLFFAGEAACIDHSGSVHGAYSSGIAAAEDCRRRLSAQLGISAGLFQVGKAAMREEMTAEAMVPFQISRL

SEQ ID NO: 119 - DNA, 2271 bp, Zea mays
agaagaagaaggaagggccatcttccgacccacttgtaggcgctgtaagcctgtaagcagtcacctctcagccacagacatggtgggcatgagaggcgcctacggtggtgcttgcaatgacgacagcaagagccggctgcacggaggcaaggcggcggagccggagatcgcgtcgatggcagtgcacaaggtggcgccgccaccggcgcggagcacggcgagcaagatgaaggtgagggtgaaggagaccttcttccccgacgacccgttccgggcgttcaaggggcagccgccggggacgcagtggctcatggcggtcaggtacctcttccccatcctggactgggtgccgagctactccttgtcgctcttcaagtccgacctcgtcgcgggcctcaccattgccagcctcgccattcctcagggcattagctacgcgaagctggcaagcttgcctcccataatcgggctgtattcgagcttcgtgccgccgatggtgtacgcggtgctggggagctcccgtgacctggcggtgggcccggtgtcgatctcgtcgctgatcatggggtccatgctgcggcaggccgtgagccccaccgcggagccgacgctgttcctgcagctggccttcacctccaccctgttcgcggggctggtgcaggcctccctgggcatcctcaggctcggcttcgtcatcgacttcctgtccaaggcgacgctggtggggttcatggccggcgccgccatcatcgtggcgctgcagcagctcaaggcgctgctgggcatcgtccacttcaccaccgagatgggcatcgtcccagtcatggcctccgtcttccaccacaccagcgagtggtcgtggcagacgatcctcatgggcgtctgcttcctcgtcttcctgctgtcggcgaggcatgtgagcatcagatggccaaagcttttctgggtttcggcgtgcgcgcccctggcatcggtcaccatctcgacgctgcttgttttcctcttcaaagctcagaaccatggcatcagcatcattgggcagctcaagtgcggcctgaatcgcccctcgtgggacaagctcctgtttgacacggcgtatttaggcctcaccatgaagactggccttgtcaccggaatcatctcactgacggaaggaatagcggttggtagaacatttgcctcactcaaggactaccagatagatggaaacaaggagatgatggccatagggttgatgaatgttgttgggtcctgcacatcatgctacgtaacaacaggtgcgttctcccgctctgctgtaaaccacaacgccggctgcaagactgccatgtccaacgtgatcatggcgctgactgtgatggtcacgctgctgttcctcatgccactgttcgtgtacacacccaacgttgtcctcggagcgatcatcatcgccgcggtgatcggcctgatcgatttccccgcggtgtaccacatctggaagatggacaagatggattttctggtgtgcgtttgcgcgtttgccggcgtcatcttcatctcagtccaagaaggccttgcgatagcggttggtatatctatatttagggtgttgatgcagatcacaaggccgaagatgatggttcaagggaacatcaaggggactgatatttacagagacctgcatcactacaaggaggcccaaagagtttctgggttcttgatcttggccattgaagcaccgataaacttcgccaactccaactacctgaatgaaaggattaaaagatggatagaggaagaatcttttgaacaggataaacatactgaactccatttcataatcttggatctgtcagctgttcctgcaattgacacaagtggcatagcgttcctcattgacataaagaaatcaatagagaaacgtggtctggagcttgtgcttgtcaatccaactggagaagtcatggagaaaatacaacgtgcaaacgaggctgaaaactattttaggccagattgcttgtatctgaccactggcgaagcaatcgcttcactttctgcacttgccaagatgacaaaaccctaaatggattgctgaattgtcattgtgttcatccctagcactgttaaaagttttcggtgcaggattttctgtaatggggagtgcatccaataggagtacatcacagctatgtttgtatctagtagaattcttcagatccatgtgatgcaaattcaatggaaaacaaatatgacagtacaatagtagatcttacagaaaaaaaaaaaaaaaaa

SEQ ID NO: 120 - protein, 628 aa, Zea mays
MAVHKVAPPPARSTASKMKVRVKETFFPDDPFRAFKGQPPGTQWLMAVRYLFPILDWVPSYSLSLFKSDLVAGLTIASLAIPQGISYAKLASLPPIIGLYSSFVPPMVYAVLGSSRDLAVGPVSISSLIMGSMLRQAVSPTAEPTLFLQLAFTSTLFAGLVQASLGILRLGFVIDFLSKATLVGFMAGAAIIVALQQLKALLGIVHFTTEMGIVPVMASVFHHTSEWSWQTILMGVCFLVFLLSARHVSIRWPKLFWVSACAPLASVTISTLLVFLFKAQNHGISIIGQLKCGLNRPSWDKLLFDTAYLGLTMKTGLVTGIISLTEGIAVGRTFASLKDYQIDGNKEMMAIGLMNVVGSCTSCYVTTGAFSRSAVNHNAGCKTAMSNVIMALTVMVTLLFLMPLFVYTPNVVLGAIIIAAVIGLIDFPAVYHIWKMDKMDFLVCVCAFAGVIFISVQEGLAIAVGISIFRVLMQITRPKMMVQGNIKGTDIYRDLHHYKEAQRVSGFLILAIEAPINFANSNYLNERIKRWIEEESFEQDKHTELHFIILDLSAVPAIDTSGIAFLIDIKKSIEKRGLELVLVNPTGEVMEKIQRANEAENYFRPDCLYLTTGEAIASLSALAKMTKP

SEQ ID NO: 121 - DNA, 1830 bp, Zea mays
cctcctcctgccgcagcccgcagggaggtggagttgtcaacgtgccgaggactggagcgcccgcgtccggcgtctctataaacgagaccgcccggccatttggtctgctcctctctgttctcccctgcctgcctgcttccagctgcatctctctccgccgagaccgagaggaggaggaggcaagggaggcatccctgacgtacggacggcggccatggggacgcaggcgccggagaactaccccgccgagaaggtacaggacgcgaggagcgcgcgggagaaggccatcgacgactggctcccgatcacctcgtcgcggaacgccaagtggtggtactccgccttccacaatgtcaccgccatggtcggcgccggcgtgctcagcctgccctacgccatgtccgagcttggctggggccctggcatcgcggtgctggtggtgtcgtgggtgatcacgctgtacacgctgtggcagatggtggagatgcacgagatggtccccgggaagcggttcgaccgttaccacgagctggggcagcacgcgttcggggaccggctgggcctgtggatcgtggtgccgcagcagctggtcgtcgaggtgggcgtgaacatcgtgtacatggtgaccggcggcaagtccctgaagaagttccacgacgtgctggtgtgcggcgacacgggggtgtgcgaggggaaggacaacatcaagaccacctacttcatcatgatcttcgcgtccgtccacttcgtcctctcgcagctccccaacttcaactccatctccggcgtctccctcgccgccgccgtcatgtcgctcagctactccaccatcgcgtggggcgcgtcggtgcacaaggggaggatgtcgggcgtcgactaccacctgcgcgcgaccaccacgccggggaaggtgttcggcttcttcggcgcgctgggggacgtggcgttcgcctacgccggccacaacgtggtgctggagatccaggccaccatcccgtccacccccgacaagccgtccaagaagcccatgtggaagggcgtggtggtcgcctacgtcgtggtggcgctctgctacttccccgtcgcgctcatcggctactgggcgttcggaaacacggtcgaggacaacatcctcatcacgctcagcaagcccaagtggctcatcgcgctcgccaacatgatggtcgtcgtccatgtcatcggcagctaccagatctatgccatgccggtgtttgacatgatagagaccgtgctggtgaagaagctgcgcttccctcccggcctcacgctgcgtctgatcgctcggaccctctatgttgcgttcacgatgttcatagccatcaccttccccttcttcggtgggctgctcggtttcttcggcgggttcgccttcgcgccgaccacctatttccttccctgcgtcatgtggctcgcaatctacaagcccaagaggttcagcctctcctggttgaccaactggatgtgcatcattcttggggtgctcctgatgattctgtcgcccatcggagggctccggcaaataataatggacgcgaaaacctaccagttctactcgtgagctaccaccagccatgacttgtaagcacgattggagaaatctgtcaaagcctcaaccacgagtttttgtttttgttttttgtcatgccaaacacatacatatacgtactgttttttttaatattcaaaggtgttcttcgtggcttgcgtgtgtacagtattatgtgtatgagggagacataagtttaatgatgctggctgtcaaagataatggcggttcaattacactttcatctcaaaaaaaaaaaaaaa

SEQ ID NO: 122 - protein, 454 aa, Zea mays
MGTQAPENYPAEKVQDARSAREKAIDDWLPITSSRNAKWWYSAFHNVTAMVGAGVLSLPYAMSELGWGPGIAVLVVSWVITLYTLWQMVEMHEMVPGKRFDRYHELGQHAFGDRLGLWIVVPQQLVVEVGVNIVYMVTGGKSLKKFHDVLVCGDTGVCEGKDNIKTTYFIMIFASVHFVLSQLPNFNSISGVSLAAAVMSLSYSTIAWGASVHKGRMSGVDYHLRATTTPGKVFGFFGALGDVAFAYAGHNVVLEIQATIPSTPDKPSKKPMWKGVVVAYVVVALCYFPVALIGYWAFGNTVEDNILITLSKPKWLIALANMMVVVHVIGSYQIYAMPVFDMIETVLVKKLRFPPGLTLRLIARTLYVAFTMFIAITFPFFGGLLGFFGGFAFAPTTYFLPCVMWLAIYKPKRFSLSWLTNWMCIILGVLLMILSPIGGLRQIIMDAKTYQFYS

SEQ ID NO: 123 - DNA, 1414 bp, Zea mays
cgagcacgcaccagcatccttggcacttggcagcgatctgcttgcttctcccagcgcgcgcggccaagctagtaggggtctaggggatcgatcagatatccacgccatggccgccgcctccaccacgtcgaggaccaactcgcgggtgaactactcgaacgagatccacgacctctccaccgtgcagagcggctccgtcgtccccaccttgttctacccggacaagtccatcgccgacatcttcccgccgcaccttgggaagaaggtgatctcggaggtggtggcgacgttccttctggtgttcgtcacctgcggggcggcgtccatctacggcgaagacaacaggcgcatctcgcagctggggcagtcggtggccggcgggctcatcgtcaccgtcatgatctacgccaccggccacatctccggcgcgcacatgaaccccgccgtcacgctctccttcgcatgcttccggcatttcccatggattcaggtgcccttctactgggcggcgcagttcacgggggcgatgtgcgcggcgttcgtgctcaaggcggtgctccaccccatcgccgtgatcggcaccaccacgccgtcggggccgcactggcacgcgctcctcatcgagatcgtcgtcaccttcaacatgatgttcgtcacctgcgccgtcgccaccgactccagggcggtgggtgagttggcagggttagcagtcggttccgcggtttgcattacttccatcttcgcagggccggtgtcgggcggatcgatgaacccggcgcggacgctggcgccggcggtggccagcaacgtcttcacgggcctctggatctacttcctcggccccgtcatcggcacgctctccggggcgtgggtctacacctacatccgcttcgaggaggcccccgccgccaaggacacgcagaggctctcctccttcaagctccgccgcatgcagagccagctcgccgccgacgagttcgacaccgtctaaattaaaacgcccacacgcgcatccacaacactgtcagcctgcaggtcaactcttcgcgcgtacgtacgctggacgctggctgagagagtgagtgagagagagagagagtactgtactactgtgtgctcgctcgctcgctctgttcaaagacctcatcatatcaggtgggagctagagagatagagctgcgtgtatgtatgtgtgtgtgtgtacgtgcttggtgtaccctacctagcgggtgagagcagctagcgtgatgtttatgtatcttcgtcagtgttgcaaaagttaattgatatgcagctgatgtgtctggctttgctggtttgcaaaagatgcatgcatgtgttggaactcggaacacaaatatatatatgggtttttttttgtctaaaaaaaaaaaaaaaaaaaaaaaaaaaaaaa

SEQ ID NO: 124 - protein, 294 aa, Zea mays
MAAASTTSRTNSRVNYSNEIHDLSTVQSGSVVPTLFYPDKSIADIFPPHLGKKVISEVVATFLLVFVTCGAASIYGEDNRRISQLGQSVAGGLIVTVMIYATGHISGAHMNPAVTLSFACFRHFPWIQVPFYWAAQFTGAMCAAFVLKAVLHPIAVIGTTTPSGPHWHALLIEIVVTFNMMFVTCAVATDSRAVGELAGLAVGSAVCITSIFAGPVSGGSMNPARTLAPAVASNVFTGLWIYFLGPVIGTLSGAWVYTYIRFEEAPAAKDTQRLSSFKLRRMQSQLAADEFDTV

SEQ ID NO: 125 - DNA, 1926 bp, Zea mays
  misc_feature 935, 939, 945: n = A,T,C or G
gaccagcatctataacagccgccaccttcccccttatactcgccggaggccaaccagtactcgtgccacgactgccacccctcctcttccttgtgatctccgaatacccatctcagattccaagggccgcgccgtgtaatccccggctctccccacccaccatatatctagtatccgcgcctcaaatccctcgcgaaacgccccgccgtaagcagttgttgtctgccgtgatttgagccgggcggacggattgatcccgggacgaggtgtctcagctcttgatcttgatcctgatcctgggaggcgttcctggtttattggtgggagcgaagaagccatgataccttccgtgaggctctctcctggtcctgcagccttctcaggctccagcctacgctcaaaattaccgtcaattccatccatctccagtctcaaaccctccaaatatgtggtctcctcgctgaaaccactctacctagcaccgctagatggtccgcgcactgccgagcttaagtctcggagacagccacttgagttccgttgttctgcttctgctgctgatgacaaggagtcaaagactcaggtggtgccagttcagtcggaaggcgcacagaggttgaagatctccatctatttcgccacctggtgggcgcttaatgtgatatttaacatttacaacaagaaggttctcaatgcattcccttacccctggctcacctccacactctccctcgcctgtggctctgctatgatgcttttctcgtgggccacccgtcttgttgaggcccctaagaccgacctggacttctggaaagttcttttcccggttgctgtggcgcatacaattggccatgttgctgctacagtgagcatgtctaaggtggcagtgtcattcacacacataattaaaagcgcagaacctgcattcactgggngggngtcaangtccctcctgggggagacgtttccagtaccagtctatctttctcttcttccaatcattggtggttgtgctctagctgctgtcacagagctgaactttaatatggttggatttatgggtgccatgatatccaaccttgcatttgttttccgcaacatcttctcgaagaggggcatgaaggggaagtccgtcagtggcatgaattactacgcttgcctgtcaattatgtccctggtcatactgactccatttgctatagctatggaaggccctcaaatgtgggctgctggttggcaaaaggctcttgcagaagttggacccaatgttgtctggtggattgctgcacagagcgtgttctaccacttatataaccaggtgtcctacatgtctctcgatcagatttctccattgacattcagcattggcaatacaatgaagcgtatatcagtgattgtttcatcaatcattatcttccacactcctgtccgcgctgtcaatgcactgggagctgccattgccatccttggcacattcctgtactctcaggcaaaggcgtgaggcgggccatgatgacgaacgtctgcagaatcagtagcaagcactaaatccaattttgcttgttccagtggcatgtagatatcgggttaggtttccgtatgagagtttgtaataatggatgaatggctctgctgtttcgttcttgtttgttggccagactcaaatccataggccatgaactgcggtcgagtgtacctgaataatactgtaacggagaattcgccgatgctgtttctttatgggtatatatatagtccaagccggaatcccgtttttaaaaaaaaaaaaaaaaaaaaaaaaaaaaaaaaaatagcagagaatgagttaggaccattagcgcttgttttttttaaaaagaattgttctttttattcgttactttaaataaccacttctatttttaatctaaaaaaaaaaaaaaaaaa

SEQ ID NO: 126 - protein, 387 aa, Zea mays
  VARIANT 200, 201, 203: Xaa = Any Amino Acid
MIPSVRLSPGPAAFSGSSLRSKLPSIPSISSLKPSKYVVSSLKPLYLAPLDGPRTAELKSRRQPLEFRCSASAADDKESKTQVVPVQSEGAQRLKISIYFATWWALNVIFNIYNKKVLNAFPYPWLTSTLSLACGSAMMLFSWATRLVEAPKTDLDFWKVLFPVAVAHTIGHVAATVSMSKVAVSFTHIIKSAEPAFTGXXSXSLLGETFPVPVYLSLLPIIGGCALAAVTELNFNMVGFMGAMISNLAFVFRNIFSKRGMKGKSVSGMNYYACLSIMSLVILTPFAIAMEGPQMWAAGWQKALAEVGPNVVWWIAAQSVFYHLYNQVSYMSLDQISPLTFSIGNTMKRISVIVSSIIIFHTPVRAVNALGAAIAILGTFLYSQAKA

SEQ ID NO: 127 - DNA, 2911 bp, Zea mays
cactcagtctgcaaataccccacaaggccactccaaagagctagtagttgcagttagctctgccggtagtggaaccgaagatgttcgggaacatcggaaagatccccatcattggcgacctgacgggcagcaacaagaatgcgcacctcaagggcaacgtggtgctcgtgcgcaagaccgtgctcggcttggacgtcaccagcatcgccggctccctcctcgacggcgtcggcgagttcctcggccgcggcgtcacctgccagcttatcagctccaccgtcgtcgaccctaacaacggcaaccgcgggaagttgggcgcggaggcgagcctggagcagtggctgctgaacccgccgccgcttctgtccagcgagaaccagttccgcgtcaccttcgactgggaggtggagaagcagggcatcccgggcgccatcatcgtcaagaacaaccacgcctccgagttcttcctcaagaccatcaccctcaacgacgtccccggccacggcaccatcgtcttcgtcgccaactcatggatctacccgcagtccaagtaccgctacaaccgcgtcttcttctccaacgacacgtacctccccagccagatgccggcggcgctgaagccctaccgcgacgacgagctccggaacctgaggggcgacgaccagcagggcccgtaccaggagcacgaccgcgtctaccgctacgacgtctacaacgacctcggcctgcctgacagcgggaacccgcgccccgtcctcggcggcaccaaggagctcccctacccgcgccgctgccgcaccgggcggaagcccaccaagagcgaccccaacagcgagagcaggctcacgctggtcgacggcgacgtctacgtgccgcgcgacgagcgcttcggccacatcaagaagccggacttctacggctacgccatcaaggcgctggtgaacgccgtcatcccggcaatccgcacctacgtcgacctgtcgcccggcgagttcgactccttcaaggacatcatgaagctgtacgagggcgggatccagctgcccaaaataccagccctcgaggacctgcggaagcagttcccactcgagctcgtcaaggatgtcctcccggtcggcggcgactacctcctcaagctccccatgccgcagatcatcaaagaggacaagacaggttggatgacagatgaggagtttggacgggagattctcgccggcgtgaaccccttgctcgtcaagcgtctcacggagttccctccgaggagcagtcttgacccgagcaagtacggcgaccacaccagcaccatcagggaggcggacctcgagaacaagctcgagggcctgaccgtgcagcaggcgctgcacggcaaccggctctacatcctggaccaccacgacaacttcatgccgttcctggtcagggtgaacagcctggagggcaacttcatctacgccaccaggaccgtgctgttcctgcgcggcgacggcacgctggtgccggtggccatcgagctgagcctgcccgagctccgggacggcctgaccaccgccaagagcaccgtgtacacgcccaagtcgaccaccggcgcggaggcgtgggtgtggcacctggccaaggcctacgccaacgtgaacgactactgctggcaccagctcatcagccactggctcaacacccacgccgtgatggagccgttcgtgatcgccaccaaccggcagctcagcgtgacgcaccccgtgcacaagctcctcctgccgcactaccgtgacaccatgaacatcaactccaacgcgcgccagatgctcgtcaacgccggcggcatcttcgagaccaccgtcttcccgcgccagtacgcgttcgagatgtcctccgtcatctacaaggactggaacttcacagagcaggctctccctgacgacctaatcaagagaggcatggcggttgccgacccgtcgagcccgtacaaggtaaggctgctggtggaggactacccgtacgcgtcggacgggctggccatctggcacgccatcgagcagtgggtgacggagtacctcgccgtctactaccccaacgacggcgtgctgcgggcggacgtggagctgcaggcgtggtggaaggaggcgcgcgaggtcgggcacgccgacctcaaggacgcgccctggtggcccaagatgcagacggtggccgagctggtcaaggcctgcaccaccatcatctggatcgcgtcggcgctccacgcggccgtcaacttcgggcagtacccgtacgccgggtacctcccgaaccgcccgtccgtcagccggaagccgatgccggcgccgggcagcgacgagtacgcggagctggagcgcaagccggagaaggtgttcgtgcgcaccatcaccagccagttccaggccctcgtcggcatctcgctgctggagatcctgtccagccactcctccgacgaggtgtacctcggccagcgcgacaccaaggagtggacgtcggacgccaaggcgcaggaggcgttcaagcggttcggcgcgcggctgaccgagatcgagaaacgcgtcgtcaccatgaacgcggaccctcgcctcaagaaccgcaacggcccggccgagttcccctacacgctgctctaccccaacacctccgacacgaagggcgacgccgccggcatcaccgccaagggcattccaaacagcatctccatttgagttctgtctgtctgagctgaggacgtacggtcgtcgcactagttgtttgcgtttccccgttccgttccgtgaagtgtggttctcacttgcgcggtattgtgcaaatagccaagtactccttacggaagtcgctacgtgaggactgttgtaataaggctctattcagttcctcaataatgaagttactttgtgttcaaaaaaaaaaaaaa

SEQ ID NO: 128 - protein, 873 aa, Zea mays
MFGNIGKIPIIGDLTGSNKNAHLKGNVVLVRKTVLGLDVTSIAGSLLDGVGEFLGRGVTCQLISSTVVDPNNGNRGKLGAEASLEQWLLNPPPLLSSENQFRVTFDWEVEKQGIPGAIIVKNNHASEFFLKTITLNDVPGHGTIVFVANSWIYPQSKYRYNRVFFSNDTYLPSQMPAALKPYRDDELRNLRGDDQQGPYQEHDRVYRYDVYNDLGLPDSGNPRPVLGGTKELPYPRRCRTGRKPTKSDPNSESRLTLVDGDVYVPRDERFGHIKKPDFYGYAIKALVNAVIPAIRTYVDLSPGEFDSFKDIMKLYEGGIQLPKIPALEDLRKQFPLELVKDVLPVGGDYLLKLPMPQIIKEDKTGWMTDEEFGREILAGVNPLLVKRLTEFPPRSSLDPSKYGDHTSTIREADLENKLEGLTVQQALHGNRLYILDHHDNFMPFLVRVNSLEGNFIYATRTVLFLRGDGTLVPVAIELSLPELRDGLTTAKSTVYTPKSTTGAEAWVWHLAKAYANVNDYCWHQLISHWLNTHAVMEPFVIATNRQLSVTHPVHKLLLPHYRDTMNINSNARQMLVNAGGIFETTVFPRQYAFEMSSVIYKDWNFTEQALPDDLIKRGMAVADPSSPYKVRLLVEDYPYASDGLAIWHAIEQWVTEYLAVYYPNDGVLRADVELQAWWKEAREVGHADLKDAPWWPKMQTVAELVKACTTIIWIASALHAAVNFGQYPYAGYLPNRPSVSRKPMPAPGSDEYAELERKPEKVFVRTITSQFQALVGISLLEILSSHSSDEVYLGQRDTKEWTSDAKAQEAFKRFGARLTEIEKRVVTMNADPRLKNRNGPAEFPYTLLYPNTSDTKGDAAGITAKGIPNSISI

SEQ ID NO: 129 - DNA, 1388 bp, Zea mays
ctaccctaaaccatctcattctcaccgatatatcatatatatacacccctctccgtccgtctccctaccgctcccgtcccgtccgctggctctggctctgcatatcccgcgcccgactcccgttgctgcgtgcggcggcccgactagtcgcgccgcgctgcgctcggcttgattgaaccggccgggatgggggtgttggaggacctcgtggcgagagcgggcgggtgcgcggtcatcgacggcggcttcgccacgcagctggaggcgctcggcgccgacatcaacgacccgctctggagcgccgcttgcctcatcaccaggccgcacctcgtcaaggaggttcatatgcagtatcttgaagctggtgcggacgtcatcatttcatcatcttaccaggcaacaatcccgggtttcatagctagaggaatgtctgtcgctgaggcagaagatttactgcgaacaagtgtaaaactggccaatgaagctcgagatgaattttggaagtcaacactgaggaagtccaaacctatttacaaccgtgctctggttgctgcatccattggtagctacggagcctatcttgctgatggatcggagtacagtggatcatacggtgctgacatcacagccgagaagctgaaggacttccacaggcgccggctgcaggttcttgcaagtgccggtcctgacctgattgcgtttgaggccattcctaaccaaatggaggcacaggcattggttgagcttctggaggaagagaaagtccagatcccttcctggatctgcttcagctccgtggacggtaagaacctgtgctctggggagagttttgcggactgccttaagatcctcaacgcgagcgagaaggtggccgttgtaggcgtgaactgcacacctcctcagttcatcgagggcatcatatgtgaatttaggaagcaaaccaagaaggcgattgcagtttacccgaacagcggcgaagtttgggacgggagagcgaagaggtggctgccggttgagtgcttgggtcacaaaagcttcgacgctctcgcgaagagatggcaggaggcgggggccagcctcatcggagggtgctgccggacaacgccttcaactattagggctgtttccaagatcctcaaaggaaggacggggcattgatttgtttattataattgagctgttgttgcattatgtcactagccagaataacattcagaatatcctgttgctcttccgttcccctttctaaaataaggtatcaatataattttgcagtgtaaaacgtaatactagtttgtagcgctgacccacagtattgcttagtccccgaaaaaaaaaaaaaaaaaaaaaaaaaaaaaaaaaaaaaaaaaaaaaaaaaaaaaaaaaaa

SEQ ID NO: 130 - protein, 323 aa, Zea mays
MGVLEDLVARAGGCAVIDGGFATQLEALGADINDPLWSAACLITRPHLVKEVHMQYLEAGADVIISSSYQATIPGFIARGMSVAEAEDLLRTSVKLANEARDEFWKSTLRKSKPIYNRALVAASIGSYGAYLADGSEYSGSYGADITAEKLKDFHRRRLQVLASAGPDLIAFEAIPNQMEAQALVELLEEEKVQIPSWICFSSVDGKNLCSGESFADCLKILNASEKVAVVGVNCTPPQFIEGIICEFRKQTKKAIAVYPNSGEVWDGRAKRWLPVECLGHKSFDALAKRWQEAGASLIGGCCRTTPSTIRAVSKILKGRTGH

SEQ ID NO: 131 - DNA, 776 bp, Zea mays
gagctccctaactgcaccggccgccacaccaccgtaccccgacccctcgacaacaatggccaccgtcctaggcagcccccgcgcgccggccttcttcttctcgccgtcctccctccgtgccgcgccggcgcccaccgccgtggcgctgcctgcggccaaggtgggcatcatgggccgtagcgccagcagcaggggcaggctgcgcgcgcaggccacctacaacgtgaagctgatcacgccggagggggaggtggagctgcaggtgcccgacgacgtgtacatcctggaccaggccgaggaggacggcatcgacctgccctactcctgccgcgcggggtcctgctcctcctgcgccggcaaggtcgtctccggctccgtggaccagtccgaccagagctacctcgacgacggccagatcgccgccggctgggtgctcacctgccacgcctaccccacctctgacgtcgtcatcgagacgcacaaggaggaggagctcaccggcgcataatcattcatgcccatccatctctatctctgtgggtcgtcgttgtgtgtaatttgagtacgcgcgtacacgtactgcttttgtttcatttgagcactgttcgtgtaagcgtcgagttgccctgccatcgtctctctctctctcgatctctactatttctgtgtgtgcgcgcttctatttttccaatgttgagttacgcatatttgtccagtaaccttgttttgcttaatcacacacagctcccaaaaaaaaaaaaaaaaaaaaaaaaaaa

SEQ ID NO: 132 - protein, 150 aa, Zea mays
MATVLGSPRAPAFFFSPSSLRAAPAPTAVALPAAKVGIMGRSASSRGRLRAQATYNVKLITPEGEVELQVPDDVYILDQAEEDGIDLPYSCRAGSCSSCAGKVVSGSVDQSDQSYLDDGQIAAGWVLTCHAYPTSDVVIETHKEEELTGA

SEQ ID NO: 133 - DNA, 5617 bp, Zea mays
ccgcctctcacctctccagtccccacccccgcccccgtccgctccctatcctgttcgttcccctcctctccacacgatcccctcccttgtcggcttccgcgcgggcgggagtggccgcggccacgactccaccgcctcctgctcgcgccaccacccctcggcccctcgcggcgccgcgcgaccggcgcgtggtgcgcgtttgcctgcccgtcgtcggccccttcttattagttattattaggcggaggagaggctagctctgcggggggtcgccgcgcgccgccgaatcggatcacacgcctccccttcccgccaggccagggggccatggccacgctcccgcgcgccgcgccgcccacgcccgccgcgctgctcccgctgccccgcgccgcgccgccgctgctgctcgccgggagggccgccgccgcgcgccgctctcggctgcgcgcgcggggcccgtccgcggcggcgcgccggagctgggtcgtcgcctccgccgcttcctcctcctcacgggccgtggtcggcggcgtcgcccgccgggaggcccctcccgcgccgcagaagcccacgcagcaggctgcggacttgaaccatatcttgtctgaacgtggagcttgtggtgttggatttgtcgcaaacttgaaaaatatgtcttcatttgacattgttcgtgatgctcttatggctcttgggtgcatggagcatcgtggtggttgtggagcggacagtgactcaggtgatggtgcaggactgatgagtgccgttccatgggacttgtttgatgactgggccagcaagcaagggcttgctctctttgacagaagaaatacaggtgtaggcatggtcttccttccacaagatgagaagtcaatggaagaagccaaagctgcaactgaaaaggtttttgtggatgaaggccttgaggttcttggttggagacccgttccttttaatgtatcagttgtaggtcgcaatgcaaaagaaaccatgcctaatatacaacaaatatttgtgaaagttgcaaaagaagataatgctgatgacatagagagagaattatacatcagccgaaagctgatagagcgggctgcaaaatcttttagttgggcagatgaactttatttctgctctttatcaagcagaacgattgtctacaagggaatgctacgatctgaggttcttgggcaattctatttagaccttcagaatgaactgtataaatcaccttttgccatatatcatcgaagattcagtacaaatacaagtcctcgatggcctcttgctcaacctatgaggttacttggacacaacggagaaattaacacaatacaggggaacttgaactggatgcgatcaagggaaaccacactaaagtctcctgtatggcgaggtcgtgagcatgaaatttgcccgtttggtgaccctaaagcatctgattcagcgaatcttgacagtacagctgaattgctgctaagaagtggtaggagtcctgcagaagctcttatgattctcgtccctgaggcatataagaaccatccaacattatctataaaataccccgaggtaactgacttttatgactactacaaaggacaaatggaagcttgggatggacctgctttacttctatttagtgatgggaggactgtaggagcaactcttgataggaatggtctccgtccagcacgctattggagaacgtcagatgacttcgtttatgtcgcatctgaagttggtgttataccaatggatgagtcaaaagtagtaatgaaaggacgattaggtcctggaatgatgataactgttgatctacagactggacaggtgcttgaaaacacagaagtaaagaaaactgtggcttcagcgagcccctatgggacttggttgcaagaatgcacacgtttgataaagcctgtcaacttcctctcttcaactatcatggacaatgagactgttttgagacatcaacaggcatttggctattcaagtgaagatgtgcaaatggtgattgaatcaatggcttcacaaggaaaggaaccaacattttgtatgggcgatgacattccattagctgtattatcacaaagaccacatttgttatatgattatttcaagcagcggtttgcgcaggttacaaatcctgcaattgatccccttagagaaggtttagttatgtctcttgaggttaatattgggaaaagaggcaacatcttggaggttggccctgaaaatgctgatcaggttgcactatcaagccctgtgctgaatgaaggtgaactggaaactctattgaacgactcaaaacttaagcccaaagtactgtcaacatacttcgatattcgtaaaggtctagatggttcacttgataagacaattcaggctctttgtgaagaagctgatgctgctgtgcggagtggctctcaacttcttgttctttctgatcgttctgaagcacctgaacctactcgtcctgccataccaatacttctagctgttggcgccatccaccagcatttgattcagaatggtctccgtatgtctgcttctattgttgctgatactgctcagtgttttagcacacatcattttgcctgtctgatcggatatggtgccagtgctgtgtgtccttatctggcactagaaacatgccggcaatggaggctgagcaacaaaactcttaatttgatgcggaatgggaagatgcccacagtgaccatcgagcaggcacaaaggaactttatcaaggcagtaaaatcaggtctgctcaaaattctttcaaaaatgggtatctcactgctctcaagctattgtggagctcagatctttgaaatttatggtcttggtcaagaagttgttgatcttgccttctgtggaagtgtatcgaaaattggaggtctcacacttgatgagctgggtagggagaccttatcattctgggtgaaggcgttctctgaagatactgcaaagaggctagaaaactttggatttatccaatccagacctggaggtgaataccatgcaaataatcctgagatgtccaagctgttgcacaaagcaattcgcgagaaacgtgataatgcgtacactgtctaccaacaacatcttgcaagccgtcctgtcaatgttcttcgagatcttcttgaattgaaaagtgatcgtgcacctattcctattggcaaagtggagtctgcaacctccattgttgaacgtttttgtactggtggaatgtccctaggagccatttcaagggaaacgcatgaagctattgcaattgcaatgaatagaataggtgggaaatctaattcaggagaaggtggtgaggatccaatccgttggaatcccctcactgatgttgtagatggttattctccaacacttcctcatctcaagggtcttcagaatggtgacacagccacaagtgccattaagcaggttgcatctggacgttttggagttacaccgacattcttagtaaatgctgaccaaattgagataaagattgcgcaaggtgcaaagcctggtgaaggaggtcaacttcctgggaaaaaagtcagtgcatacattgctcgtctgaggaactccaaacctggagttcctctaatctccccgcctccacaccatgacatttattctatcgaggatcttgcacagttgatttatgacctccatcagataaatcctaaagctaaagtatctgtaaagcttgtgtctgaagctggaattggaactgtagcttctggagtttcaaaggcgaatgcagacataattcagatatcaggtcatgatggtggtactggagctagcccaatcagctccatcaaacatgctgggggtccgtgggaacttggtcttacagaaacaaatcagacacttatacaaaatggattgagagagagggtagtacttagggtggacggtggattcaggagtggtcaagatgttcttattgctgctgctatgggagctgatgaatatggctttggttctgtagccatgatagctactggatgtgtcatggcacggatttgtcacacaaataattgtccagttggagtggctagtcagagagaagagcttcgtgcaaggtttcctggtgttcctggtgatcttgttaactacttcctctttgttgccgaggaggttcgagctgcattagcccagttgggttatgagaagttggatgacatcattgggcgaacagatttgcttaaaccaaagcacatctcattggtgaaaacgcagcacattgatcttggatacctcctatcaaatgctggattgcctgaatggagcagctcccaaattaggagccaggacgtccacactaatggccctgttcttgatgagacaatccttgcagatcctgagatagctgatgctattgagaatgagaaggaagtttccaaggcatttcaaatctataatgttgacagagctgtctgtggtcgggtagcaggtgtgattgccaagaagtatggagacacaggttttgctggccagctcaacatcacgttcaatggaagtgcagggcagtcctttggttgtttcctgactcctggaatgaacattcggctagttggggaggccaatgattatgttggaaagggtatggctggtggagaactggtggtagttcctgtagacaaaacaggatttgttcctgaggatgctactatagttggaaacacttgtctgtatggagctacaggtggtcaggtatttgtgagaggcaaggcaggagaaagatttgctgttagaaactctctatgtcaggcagtggttgagggcaccggagatcattgctgtgagtacatgactggtggctgcgtagtcgtacttggcaaagctgggaggaatgttgcagctggaatgactggtggtcttgcctacattctagatgaggatgatacacttgtcccaaaggtcaacaaggaaatcgtcaaaatgcagagagtgaatgctccagctgggcagatgcagctaaagggcttgattgaggcctatgttgaaaaaacgggcagcgagaaaggtattgcgattttgagggaatgggaggcctatttgccgctcttctggcaactggtaccgcccagtgaagaagactcgcctgaggcttgtgcagagtttgagagagtacttgccaagcaagcaaccacccaattgtctgcgaagtgatcgaatcagactacaggaaggtggtaggtgttttctatttgacacaaagtgatctcatcttatcacttcaagaaaatcgaagaccataaccggcactctgaggcaccgaagtgcccgtctgaagactgcaactttgtggaggctctgcccaggccatctttttgagttgagctaacagaaccgagggttcttctcgacgctcgtgcacctaggtaacccctgtaaattggtttgctgacgctaggctgcaaggggcctgccctgtttgaactgctgtactgtacatgattcttggccgttgccctgtgtaattatgttttggttagctcgtaaatttatacgcatccaatggaggcatacaatgcaaaaaaaaaaaaaaaaaaaaaaaaaaaaaaaaaaaaaaaaaaaaaaaaaaaaaaaaaaaaaaaaaaaaaaaaaa

SEQ ID NO: 134 - protein, 1616 aa, Zea mays
MATLPRAAPPTPAALLPLPRAAPPLLLAGRAAAARRSRLRARGPSAAARRSWVVASAASSSSRAVVGGVARREAPPAPQKPTQQAADLNHILSERGACGVGFVANLKNMSSFDIVRDALMALGCMEHRGGCGADSDSGDGAGLMSAVPWDLFDDWASKQGLALFDRRNTGVGMVFLPQDEKSMEEAKAATEKVFVDEGLEVLGWRPVPFNVSVVGRNAKETMPNIQQIFVKVAKEDNADDIERELYISRKLIERAAKSFSWADELYFCSLSSRTIVYKGMLRSEVLGQFYLDLQNELYKSPFAIYHRRFSTNTSPRWPLAQPMRLLGHNGEINTIQGNLNWMRSRETTLKSPVWRGREHEICPFGDPKASDSANLDSTAELLLRSGRSPAEALMILVPEAYKNHPTLSIKYPEVTDFYDYYKGQMEAWDGPALLLFSDGRTVGATLDRNGLRPARYWRTSDDFVYVASEVGVIPMDESKVVMKGRLGPGMMITVDLQTGQVLENTEVKKTVASASPYGTWLQECTRLIKPVNFLSSTIMDNETVLRHQQAFGYSSEDVQMVIESMASQGKEPTFCMGDDIPLAVLSQRPHLLYDYFKQRFAQVTNPAIDPLREGLVMSLEVNIGKRGNILEVGPENADQVALSSPVLNEGELETLLNDSKLKPKVLSTYFDIRKGLDGSLDKTIQALCEEADAAVRSGSQLLVLSDRSEAPEPTRPAIPILLAVGAIHQHLIQNGLRMSASIVADTAQCFSTHHFACLIGYGASAVCPYLALETCRQWRLSNKTLNLMRNGKMPTVTIEQAQRNFIKAVKSGLLKILSKMGISLLSSYCGAQIFEIYGLGQEVVDLAFCGSVSKIGGLTLDELGRETLSFWVKAFSEDTAKRLENFGFIQSRPGGEYHANNPEMSKLLHKAIREKRDNAYTVYQQHLASRPVNVLRDLLELKSDRAPIPIGKVESATSIVERFCTGGMSLGAISRETHEAIAIAMNRIGGKSNSGEGGEDPIRWNPLTDVVDGYSPTLPHLKGLQNGDTATSAIKQVASGRFGVTPTFLVNADQIEIKIAQGAKPGEGGQLPGKKVSAYIARLRNSKPGVPLISPPPHHDIYSIEDLAQLIYDLHQINPKAKVSVKLVSEAGIGTVASGVSKANADIIQISGHDGGTGASPISSIKHAGGPWELGLTETNQTLIQNGLRERVVLRVDGGFRSGQDVLIAAAMGADEYGFGSVAMIATGCVMARICHTNNCPVGVASQREELRARFPGVPGDLVNYFLFVAEEVRAALAQLGYEKLDDIIGRTDLLKPKHISLVKTQHIDLGYLLSNAGLPEWSSSQIRSQDVHTNGPVLDETILADPEIADAIENEKEVSKAFQIYNVDRAVCGRVAGVIAKKYGDTGFAGQLNITFNGSAGQSFGCFLTPGMNIRLVGEANDYVGKGMAGGELVVVPVDKTGFVPEDATIVGNTCLYGATGGQVFVRGKAGERFAVRNSLCQAVVEGTGDHCCEYMTGGCVVVLGKAGRNVAAGMTGGLAYILDEDDTLVPKVNKEIVKMQRVNAPAGQMQLKGLIEAYVEKTGSEKGIAILREWEAYLPLFWQLVPPSEEDSPEACAEFERVLAKQATTQLSAK

SEQ ID NO: 135 - DNA, 1297 bp, Zea mays
ctctctctttctctcttgtgttcttgccttctgcctactacgagtgatggccagcctcactgacctcgtcaacctcgacctgagtgactgcacagacaggatcatcgccgagtacatctgggttggaggatccggcatagacctcaggagcaaagcaaggacggtgaaaggccccatcaccgatccgagccagctgccaaaatggaactacgacggctccagcaccgggcaggctcccggagaggacagcgaagtcatcctctaccctcaagccattttcaaggacccgttcaggaagggtaacaacatccttgtgatgtgtgactgctacacgccacaaggcgagccaatccccagtaacaagaggtacaaagctgccacggttttcagccaccccgatgttgcagctgaggtgccatggtacggtattgagcaggagtacactctccttcagaaggatgtgagctggccccttggctggcctgttggtggataccctggtccccagggaccatactactgtgctgccggtgccgataaggcctttgggcgcgacgtggttgacgcccactacaaagcctgcctctacgccggcatcaacatcagcggcatcaacggcgaagtcatgcctggacagtgggagttccaagtcgggccgtccgttgggatctctgccggcgacgagatatgggtcgcccgctacattctcgagaggatcactgagatggccggaatcgttctctccctcgacccgaagccgatcaagggtgactggaacggcgccggcgctcacaccaactacagcaccaagtcgatgagggaggccggtggctacgaggtgatcaaggaggcgatcgagaagctggggaagaggcacagggagcacatcgccgcgtacggcgagggcaacgagcgccgcctcacgggccgccacgagaccgccgacatcaacaccttcaaatggggcgtggcgaaccgcggcgcgtccatccgcgtcggccgcgacaccgagaaggagggcaagggatacttcgaggaccgcaggccggcttccaacatggacccctacgtcgtcaccggcatgatcgccgacaccaccatcctgtggaagggaaactgataaaaccactgttcttctcctgcacgcatgcatccgccccgtgctgccactttttgtttttcaaatttcgattcccgtcctaaagtttgttagcacttattatttcgctctccagtgtactgctcggaaagtccgaataaaaacggctctaatgattttgtttaaaaaaaaaaaaaa

SEQ ID NO: 136 - protein, 357 aa, Zea mays
MASLTDLVNLDLSDCTDKIIAEYIWVGGSGIDLRSKARTVKGPITDPSQLPKWNYDGSSTGQAPGEDSEVILYPQAIFKDPFRKGNNILVMCDCYTPQGEPIPSNKRYKAATVFSHPDVAAEVPWYGIEQEYTLLQKDLSWPLGWPVGGYPGPQGPYYCAAGADKAFGRDVVDAHYKACLYAGINISGINGEVMPGQWEFQVGPSVGISAGDEIWVARYILERITEMAGIVLSLDPKPIKGDWNGAGAHTNYSTKSMREAGGYEVIKEAIEKLGRRHREHIAAYGEGNERRLTGRHETADINTFKWGVANRGASIRVGRDTEKEGKGYFEDRRPASNMDPYVVTGMIADTTILWKGN

SEQ ID NO: 137 - DNA, 1868 bp, Zea mays
gcccaaggcgcgtcatgcctgccgcctttgcccgcctctgatgctcgcaaagggccagcattctctcgtccactcaacgacagcgagccctatcccctcagcaaaagccagatgcctgttgccgtcgcggccactggatgccaagtactttttatatacgccgtccgcgcccacgacccccgagacccgcctcccctcgtcgtctcgtctcgcctcgcgtcgtctgcgctcgcggctcgtcacaggtgaggtctcggcgggagaggggcggcggccggtccgtgtccgtgtccgtcgacggttggttcgggaatggcgcaggcggtggtgccggcgatgcagtgccgggtcggagtgaaggcggcggcggggagggtgtggagcgccggcaggactaggaccggccgcggcggcgcctcgccggggttcaaggtcatggccgtcagcacgggcagcaccggggtggtgccgcgcctcgagcagctgctcaacatggacaccacgccctacaccgacaaggtcatcgccgagtacatctgggtcggaggatctggaatcgacatcagaagcaaatcaaggacgatttcgaaacccgtggaggatccctcagaactaccaaaatggaactacgatggatctagcacaggacaagccccgggagaagacagtgaagtcattctatacccccaggctatcttcaaggacccattccgaggtggcaacaacgttttggttatctgtgacacctacacgccacagggggaaccccttccaactaacaaacgccacagggctgcgcaaattttcagcgacccaaaggtcgctgaacaagtgccatggtttggcatagagcaagagtacactttgctccagaaagatgtaaattggcctcttggttggcctgttggaggcttccctggtccccagggtccatactactgtgccgtaggagccgacaaatcatttggccgtgacatatcagatgctcactacaaggcatgcctctacgctggaatcaacattagtggaacaaacggggaggtcatgcctggtcagtgggagtaccaagttggacctagtgttggtattgaagcaggagatcacatatggatttcgagatacattctcgagagaatcacagagcaagctggggttgtccttacccttgatccaaaaccaattcagggtgactggaacggagctggctgccacacaaattacagcacaaagactatgcgcgaagacggcgggtttgaagagatcaagagagcaatcctgaacctttctctgcgccatgatctgcatattagtgcatacggagaaggaaatgaaagaagactgactgggaaacatgagactgcgagcatcggaacgttctcatggggtgtggcaaaccgcggctgctctatccgtgtggggcgagataccgaggcaaaagggaaaggttacctggaagaccgtcggccggcatcaaacatggacccgtacattgtgacggggctactggccgagaccacgatcctctggcagccatccctcgaggcggaggctcttgccgccaagaagctggcgctgaaggtgtgaagcagctgaaggatggttcaggcaccaatataaaccggtccgcgacaagattgatctttgtgtccatggcgtgggtcttgcgactctctgctcggcggtgccactctgtacaaaatcacggctgtctttgattcatcggatattcggatacgtttgtttgttactttttgcttggacacccaccatgtttggaacttttttgggctccgtttgggggctgaacgatggtcagtggaaattttaaaaattaatcgtcaaaaaaaaaaaaaaaaaaaaaaaaaaaa

SEQ ID NO: 138 - protein, 423 aa, Zea mays
MAQAVVPAMQCRVGVKAAAGRVWSAGRTRTGRGGASPGFKVMAVSTGSTGVVPRLEQLLNMDTTPYTDKVIAEYIWVGGSGIDIRSKSRTISKPVEDPSELPKWNYDGSSTGQAPGEDSEVILYPQAIFKDPFRGGNNVLVICDTYTPQGEPLPTNKRHRAAQIFSDPKVAEQVPWFGIEQEYTLLQKDVNWPLGWPVGGFPGPQGPYYCAVGADKSFGRDISDAHYKACLYAGINISGTNGEVMPGQWEYQVGPSVGIEAGDHIWISRYILERITEQAGVVLTLDPKPIQGDWNGAGCHTNYSTKTMREDGGFEEIKRAILNLSLRHDLHISAYGEGNERRLTGKHETASIGTFSWGVANRGCSIRVGRDTEAKGKGYLEDRRPASNMDPYIVTGLLAETTILWQPSLEAEALAAKKLALKV

SEQ ID NO: 139 - DNA, 1361 bp, Zea mays
gcgcacttgttccttccggcacagcacacaggacaccgtagacagattcatcgcgacgatggggctggacgtcgtggagatcgggatgggcgccgatttgagcctggatctgaggcacttcgcctccaaggccgtgcggcagagcaaggactacgcgccggcgccggcgccggacatggacgcctgcatccgccgcctcgaggaggagcggggcatgatcgagatgttcaagcgggagctgccgctctgcgcgcgcctcctcgcagacgtgatcgatgtgatgaaggaggaagcggggaaggcggtggcggaggaggacggcgccgccggggacaagagcaagtggatgagcacggcgcagctctggacgggcgattgcggccgcgaggacgcggaaccagagaagcaagacaaggagaggagctcgcctgaggccaggtctcgcgccgccggcggcgctttcttgccgctcaaggctgccgtgggctccggcgcgccggcgttcgcgccgctcggcttgagaatggacgacaaggccgccgcgcgcgccgggatgcccgacctgtgcttgctgtcgccgccggcgaccaagagcgccgccgaggagagccgtcgccaggtggtggggtttgcgcaggcggcgacgagggcggccgccgccactgcgccagctgccccttcgcttagcgttggcatccagtccccgtcgcagcaggcgaggaaggctcggcgttgctggtccacggagctgcatcgccagttcgtcgccgccttgaaccagctcggtggcccccaagttgccaccccaaagcagatcagggagctgatgaaggtggacggcctcacaaacgacgaagtgaaaagccaccttcagaaataccggctgcacaaccggagggcgccagggtccggcgtggtgagccagcccatcgtgctggtgggagggctgtggattccgcaggagcaaagcagctcgcagtccgggtctccccacggcccgctccacttctccacctcaggcatcgccgtctcgtcggcgggcaccgtcagctgcgaggaggaagacggacggtccgagagctatggctggaaatgatggagaggctgctgctgctgctgctagaggggagctgcagcctcaggaacgggaatcatcaggagggaaactgagagtagtgtagctgtctgtacacatacatagttacattacattacatacagggagtgagggagatcgggccttgagcgctcgagaccaaactgatgcttcgggtttgtacatcccaaagagatgagatgatacagttttgcggctaatccatgtttcgggcttttttgtcaccaaaaaaaaaaaaaaaaaa

SEQ ID NO: 140 - protein, 345 aa, Zea mays
MGLDVVEIGMGADLSLDLRHFASKAVRQSKDYAPAPAPDMDACIRRLEEERGMIEMFKRELPLCARLLADVIDVMKEEAGKAVAEEDGAAGDKSKWMSTAQLWTGDCGREDAEPEKQDKERSSPEARSRAAGGAFLPLKAAVGSGAPAFAPLGLRMDDKAAARAGMPDLCLLSPPATKSAAEESRRQVVGFAQAATRAAAATAPAAPSLSVGIQSPSQQARKARRCWSTELHRQFVAALNQLGGPQVATPKQIRELMKVDGLTNDEVKSHLQKYRLHNRRAPGSGVVSQPIVLVGGLWIPQEQSSSQSGSPHGPLHFSTSGIAVSSAGTVSCEEEDGRSESYGWK

SEQ ID NO: 141 - DNA, 3572 bp, Zea mays
ctctcctctcttctttttagtagctcgctcgccaggccgccaagccacatgcagcatgtggcggagcgcaagtaggtagctgctgcgtcttcctggcctgagggtttcggattcatcagctgggcgccggggtcgccatcgccgccgttgggacggcggcggcggagtttggcgtcgagttcttcagagggttaggtgcacgcgtctctcgcgttcctccttcccaagtcgagttcctttctttccatacccgtccccatgacgttccttcttccatgattcccttccatatttgctccagccaggccatccgcgggctgcgtggctgcgctcctgctattttaatgcctgccttctctccctctcacgcctcataaaaaaaactaataattccttgggatctgaggggatccgcgtggggttggtaggatcgcgggcagagattttagccaggactggaggaaaaccagtccgctctctctccatgagcttcggcggcatgttcgatggcgccggctccggcgtcttctcctacgacgctaccggcggcggcacgggcatgcacaaccccggccgcctcgtcccggccccgcccctgccgaaacctggcggattcggcgccacgggcctctccctcgggctgcaaacgaacatggaaggggctcagctgggcgacttgggtcgtatgggcctgattggcggcggcgggagcgggagcggaggcgacggggactcgctgggccgcggccgtgaggacgagatcgacagccggtcaggcagcgacaacgtcgacggcgcctccggtgacgagatcgacccggacaacagtaaccctcgcaggaagaagaagcgataccaccgccacacaccgcagcaaatccaagaactcgaagctgtgttcaaggagtgcccccaccccgacgagaagcaaaggatggagctcagcaagcggctcaacctagagagccgccaggtcaagttctggttccagaaccgccgcacgcagatgaagacgcagatcgagcggcacgagaacgcgctgctgaggcaggagaacgacaagctgagggcggagaacatgacgatccgggaggcgatgcgcaaccccatctgcgccaactgtggcggcgccgccgtgctcggggaggtgtcgctggaggagcagcacctccgcatagagaacgcgcggctcaaggacgagctggaccgcgtctgcgccctcgccggcaagttcctcggccgcccaatctcctctggcagctccatgtcgtcgtccctgcaaggctgctccggcctcgagctcggcgtcggctccaacaacggctacgggctcggtcccctcggcgcgtcagcgctgcagcccctccccgacctactcggcgccggccttccgggccccgtgggctcggccgccatgcgcttgcccatgggcattggcgccctcgacgttgcgctgcacggggcggccgccgacggcatcgaccgcaccgtcctcctcgagctggcgctcgccgcgatggaggagctcatgaaagtggcgcagatggacgagccgctctggctccgcagccccgacggcagcggcttggaggcgctcaacctcgacgagtaccaccgagcgttcgccagggtgttcgggccgagccccgcgggctacgtcaccgaggctacccgcgaggccggcgtcgccataaccagcagcgtagacctcgtagacagcctcatggacgcggctcggtggtcggagatgttcccgtgcatcgtggcgagggcgagcacgacggacatcatctcgagcggcatgggcggcacgcgcagcgggtcaatccagctgatgcacgcggagctgcaggtgctgtcgccgctggtgccgatccgtgaggtggtgttccttcggttctgcaagcagcacgccaaggggctgtgggccgtggtcgacgtctcggtggacgccatcctccggcccgacggcggccaccaccacgcgcagaacggcggcggcgccgggtacatgggctgccgcctgctccccaccggctgcatcgtgcaagacatgaacaacggctactccaaggtcacgtgggttgtccacgcggagtacgacgaggcggtggtgcaccaactctaccgcccgctgctccagtccggccaggcccttggcgcgcgccgctggctcgcctcgctccagcgccagtgccagtacctcgccatcctctgctccaactctctccctgcccgcgaccacgccgcgatcacgccggtggggcggaggagcatgctgaagctggcgcagcggatgacggacaacttctgcgccggtgtgtgtgcgtcggcggcgcagaagtggcggcgcctggacgagtggcgcagcggcgagggaggagacgctgctgggaacggcggatcagcagccgcgggcgagggcgaggagaaggtgcggatgatggcgcggcacagcgtgggggcgcccggggatccccccggcgtggtgctcagcgccaccacgtcggtgcggctgcccgccacgtccccgcagcgcgtgttcgactacctccgcgacgagcagcgccgcggcgagtgggacatcctggccaacggtgaggcaatgcaggagatggaccacatcgccaagggccagcaccacggcaacgccgtctccctcctccgcccaaatgcaactagtggcaaccaaaacaacatgctcatcctgcaagagacctgcaccgacccatcaggctctctggtggtgtacgccccggtggacgtgcagtccatgcacgtcgtcatgaacggtggcgactccgcctacgtctctctcctcccctctgggttcgccatcctcccggacggccactgccagtcaccaaaccctgcccatcagggttcaccaagctgcggcggtagcggtagcagcagcagcacggggtctctagtgacggtggcattccagatcctggtgaacaacctgcccaccgcgaagctcaccgtggagtcggtggagaccgtcagcaacctgctctcctgcaccatccagaagatcaagtctgcgctccaggccagcatcgtcacgccctagctagcgggcatttgacatggattccggccgccggttctcagaaaaaaggacggagtagtcggatgccatgtcaaatgcttagctagaggacgacatgctgtaacggcgcagatgctaaacaaggctgtgctcgtacgtacgtcgatcgtttcatagcaggtcggggaactagtgcttgagaaggcagtgaaagaaaataagggtattaaaataaattatgtagtagtgtggagtatttattgcatagagcaatatatatatggggtgaggtacacagggattaagtcaagaacgaaccgttcgctaggctttgattgcttgagcaaacacgttttgctatcgctcaagcttgttatatgctcatgtggtggttcgggtattgacttaagtctctggcaaaagaaagtgaaacaccacctattagggcttctcctatatataaaatatatatgtagcagtttgttttcaaaaaaaaaaaaaaaaaaaaaaaaaaaaa

SEQ ID NO: 142 - protein, 863 aa, Zea mays
MSFGGMFDGAGSGVFSYDATGGGTGMHNPGRLVPAPPLPKPGGFGATGLSLGLQTNMEGAQLGDLGRMGLIGGGGSGSGGDGDSLGRGREDEIDSRSGSDNVDGASGDEIDPDNSNPRRKKKRYHRHTPQQIQELEAVFKECPHPDEKQRMELSKRLNLESRQVKFWFQNRRTQMKTQIERHENALLRQENDKLRAENMTIREAMRNPICANCGGAAVLGEVSLEEQHLRIENARLKDELDRVCALAGKFLGRPISSGSSMSSSLQGCSGLELGVGSNNGYGLGPLGASALQPLPDLLGAGLPGPVGSAAMRLPMGIGALDVALHGAAADGIDRTVLLELALAAMEELMKVAQMDEPLWLRSPDGSGLEALNLDEYHRAFARVFGPSPAGYVTEATREAGVAITSSVDLVDSLMDAARWSEMFPCIVARASTTDIISSGMGGTRSGSIQLMHAELQVLSPLVPIREVVFLRFCKQHAKGLWAVVDVSVDAILRPDGGHHHAQNGGGAGYMGCRLLPTGCIVQDMNNGYSKVTWVVHAEYDEAVVHQLYRPLLQSGQALGARRWLASLQRQCQYLAILCSNSLPARDHAAITPVGRRSMLKLAQRMTDNFCAGVCASAAQKWRRLDEWRSGEGGDAAGNGGSAAAGEGEEKVRMMARHSVGAPGDPPGVVLSATTSVRLPATSPQRVFDYLRDEQRRGEWDILANGEAMQEMDHIAKGQHHGNAVSLLRPNATSGNQNNMLILQETCTDPSGSLVVYAPVDVQSMHVVMNGGDSAYVSLLPSGFAILPDGHCQSPNPAHQGSPSCGGSGSSSSTGSLVTVAFQILVNNLPTAKLTVESVETVSNLLSCTIQKIKSALQASIVTP

SEQ ID NO: 143 - DNA, 1255 bp, Zea mays
ccagaccaaaccaagaatacacggtacacaccactggttgtctgcttgcttctccccgtctctgttctccgccagaccaaacctgaccaaccccacccactggaccggcccgcgcccgcttggtccagcgccggccctgcctgcagccagccaccgttgtccgttccctcccgcgatccactcctctcgagctctaggggacggaaggaatccggcgggggtggggtgcgagcagggggagggagaagagcagccgcccgccccgcgagggggcaacagctgcccaagaacctgaccggaagagttgtgggagcggcggcggaaagatggggcaggccctgcgcaggctcttcgactccttcttctccaccagggagatgagggttgtgatgcttggtctggatgcagctggtaaaacaacaatactgtacaggcttcacatgggagaggttctttcaacagtccctacagtcggttttaatgtcgagaaggttcagtataagaatgtggcattcactgtgtgggatgtgggtgggcaagaaaaactcaggtcactgtggaagatgtacctgagtaattctgatgcactgatctatgtcgttgattctctggacagagaaaggatcagagacgcgaggcaagagttccagaccattatcaaggaccctttgatggcaaacagcataatcttggtatttgcaaacaaacaggacctgagaggcacgatgagcacggacgaggtcagcgaagggctggggctgcacgacctcaggaacaggatctggcacatacaggggacctgcgcgctccgcggcgagggcctctacgacgggctcgactggcttgcgtccaccctgaagcagctgcaagaatcgggccacgcgacttcggtcgctggcccttccatctgatccagcgcaagtgagctcagtgcctcagccaactgacagcaagcccacaagaatatgctccagcgcgagcgcattcctttggtgggtgtggctgcccgctggtggtggtggagttccttcggtcggtgttgccgtgttggtatcatatgagccagttgttcatccggcagggactcgcgtacttttttttctctcctgagattgtttgtaaattgttgaacggatgcaatgccggcgatgttgatcttgtgtgctggtggtgcacgtggttgttttgtctacttttttttacaataaaaaagagatcgtctgcggttctggtgattaaaaaaaaaaaaaaaaaa

SEQ ID NO: 144 - protein, 192 aa, Zea mays
MGQALRRLFDSFFSTREMRVVMLGLDAAGKTTILYRLHMGEVLSTVPTVGFNVEKVQYKNVAFTVWDVGGQEKLRSLWKMYLSNSDALIYVVDSLDRERIRDARQEFQTIIKDPLMANSIILVFANKQDLRGTMSTDEVSEGLGLHDLRNRIWHIQGTCALRGEGLYDGLDWLASTLKQLQESGHATSVAGP

SEQ ID NO: 145 - DNA, 649 bp, Zea mays
cccgtcctccctcgccttcgccttcgccagcaggagatttccaccaccaccaccgaacatccccgaccctcctcccctctcgcgctatggcccagactgttgtgctcaaggttggcatgtcctgtgagggctgtgttggagctgtcaagcgggtcctgggcaagatggaaggcgttgagtcctacgacgtagacatcatggaacagaaggtcaccgtgaagggcaatgtgacacctgacgccgtcctgcaaactgtttccaagactggcaagaagacttcgttctgggaggctgaggccgtgacaagtgaatccgccacacctgccggtgccaccgcctgacaggttcgatgatcaggaagtgcccggcaaggcggcaaagaaaaaaatgtgaatgtatttagcttggatctgttacaaataattgcaaactgctagctcggtctgtacattttacagttgctattcgtgtactgtgatgttctcgtaagtttggggagatgataaaccaatatttgtatgatatatgtgtcgtgttccataaggtaaggttttgacggtgtgctatcatcacctgaggtgactttagcatcaccaggctacttcaaaaaaaaaaaaaaaaaaaaaaaaaagaaaaaaaaaaaaaaaaa

SEQ ID NO: 146 - protein, 84 aa, Zea mays
MAQTVVLKVGMSCEGCVGAVKRVLGKMEGVESYDVDIMEQKVTVKGNVTPDAVLQTVSKTGKKTSFWEAEAVTSESATPAGATA

SEQ ID NO: 147 - DNA, 1405 bp, Zea mays
ggcggctagcgctggtgcgtgcttcctccattatattatcattgcgcctcgtcctccccaatcctcattgcccatcacattccatcgaccagtctcaattcaaggagctgaggacgacctgtccgtccggagctgatcgagaaacggaggggcggttccagtttcagtccagctagctagctagctagaagatcccattcgctgacagatgggttcctacatccaaggagatgatgaggtccctgtgtacgagtcgggcgccgaggtgcttgcgaaggtgcaagagaaatgggcggcggcggcggcatcgcggcctcctccctacccggccatgtactcgagcgtgttcggcggcatcatcctggacccggccatgatggttctccccatcgacgaccacatggtccaccggggccacggcgtgttcgacacggccatgatcctggacggcgccctgtacgagctggacgcgcacctggaccgcttcctccggtcggccgcggcggcgcgcgtgggcacggccccgttcccgcgcgaggcgctgcggcgcatcctgatccagatgaccgccgcctcgggctgccgcatgggctccatccgctactggctcagctccgggcccggcgacttcctgctgtcctccaggggctgcccgtcgccggcgttctacggcgtggtgatcgcgtcggagtacgagcagtgcggggtggacggcaccggggtgcgcgcggtcacggccacggtgcccatgaagccgccgcagttcgcgaccgtgaagaacgtgaactaccttcccaacgtgctgtccatcatggacgccgaggaccgcggcgccttcgcgtccgtgtgggtggacgaccaagggtacgtggccgagggccccatggtgaacgtggcgttcgtgacgcccgagcgggagctcgtgctcccggccttcgacaagatcctcagcgggtgcacggccaagaggatgctcgcgctggcgcctcgcctcgtggacgccggcctgctcgcgggcgtcagcaccagggacatcacagccgaggacgccaagcgcagcgccgagatggcgttcgtcggcagcggcctccccgtgctgcccgtcgtcgagtgggacggcaaacccatcggagacgggaaggttgggaagctgatgccggcgctgtctgatctgctgtgggaggacatgaagtccggtcccgacaggatccccgttccatacaagcagtagcctgagcgaaggcgaagccatgacatgtctctctctctctctctgtgtatgtgtttgcagtcgaatggtgattgccttgcctgaataaaaataaacctctctctgtatatatgaaaaaaagtatttggaaatacgagcagattccatccaaaaaaaaaaaaaaaaaaaaaaaaa

SEQ ID NO: 148 - protein, 298 aa, Zea mays
MYSSVFGGIILDPAMMVLPIDDHMVHRGHGVFDTAMILDGALYELDAHLDRFLRSAAAARVGTAPFPREALRRILIQMTAASGCRMGSIRYWLSSGPGDFLLSSRGCPSPAFYGVVIASEYEQCGVDGTGVRAVTATVPMKPPQFATVKNVNYLPNVLSIMDAEDRGAFASVWVDDQGYVAEGPMVNVAFVTPERELVLPAFDKILSGCTAKRMLALAPRLVDAGLLAGVSTRDITAEDAKRSAEMAFVGSGLPVLPVVEWDGKPIGDGKVGKLMPALSDLLWEDMKSGPDRIPVPYK

SEQ ID NO: 149 - DNA, 1617 bp, Zea mays
ttttttttgttccttgggaggatagaaaaaatatatccttggttttcttgaacagataacatttcaggtgtgcttctgaagggagatttcgttgaacaggatgaatgcattggcagcaaccagcaggaacttcaagcaggcagctaagctgctgggcctcgactccaagctggagaagagcttgctcattccattcagggagatcaaggttgaatgcacaatcccaaaagatgatggaactttggcatcctatgttggatttagggttcaacatgataatgctaggggacctatgaagggtggaatcagataccaccatgaggttgatcctgatgaagttaatgccttggcacaattgatgacttggaaaacagcagtagctaacataccatatggaggagccaaaggtggaattggatgtagccctggagacctgagcatctctgagcttgagaggcttacccgagtttttactcagaaaatccatgacttgattggcatccatactgacgttccagctccagatatgggcaccaactcacagacaatggcatggatacttgacgaatactcaaagttccatggttactcacctgctgttgtgacaggaaagcctgtggacctcggaggatcattgggaagagacgccgctactggaaggggagttctgtttgctactgaagctttgcttgcagagcatggcaaaggcattgcaggccagcgtttcgtcatacagggattcggtaacgttggttcctgggcagctcagctgataagtgaagccggtggcaaggtgattgctatcagtgacgtcacaggcgccgtcaaaaacgtcgatggcctcgacatcgtgcagctagtgaagcactcggcggagaacaaggggatcaagggcttcaaggggggagacgccatcgctccagactcgttgctcactgaagagtgcgacgtcctcatcccagcagcgcttgggggagtcataaacaaggataatgctaacgacataaaggcaaagtacatcatcgaggctgccaatcaccccacagatccagaggcagacgagatcctgtcaaagaaaggcgtcctcatcctccccgacatactggccaactctggtggcgtcacagtgagctacttcgagtgggtacaaaacatccaggggttcatgtgggacgaagagaaggtaaacgcggagctgcggacgtacatgacgcgcgccttcggggacgtgaagcagatgtgccggagccacagctgcgacctccgcatgggcgccttcacgctgggcgtcaaccgcgtcgcgcgcgccaccgtcctcaggggatgggaagcatgacctccctccgtgtcgtccgtgtgcccctccctgttgtatcctcttggtcttggtcttgggcccttgtttttctttggttaattattatcgatcaacggagatccgagaaaaaacgggctcagttaataattccaagaagtgcgtcttcttggagataaatagcggaaggagagttataataagtctgtaactgtaacccatagctgagatgctgtctgcaagcagcaatgccaatgccaatgccatctggttttcgtgcacgaaaaaaaaaaaaaaaaaaa

SEQ ID NO: 150 - protein, 411 aa, Zea mays
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGIAGQRFVIQGFGNVGSWAAQLISEAGGKVIAISDVTGAVKNVDGLDIVQLVKHSAENKGIKGFKGGDAIAPDSLLTEECDVLIPAALGGVINKDNANDIKAKYIIEAANHPTDPEADEILSKKGVLILPDILANSGGVTVSYFEWVQNIQGFMWDEEKVNAELRTYMTRAFGDVKQMCRSHSCDLRMGAFTLGVNRVARATVLRGWEA

SEQ ID NO: 151 - DNA, 1727 bp, Zea mays
gtaccccacaccactaggcactagtccactacctaacgctacctgccttttcaccgcgtcgtgcgccaccgccacgttgagctcgcgtccgtcccagatccgccgtgctcctccatcgctcgcgcaagatgaagatcacggtgcgggggtcggagatggtgtacccggcggcggagacgccgcgccgccggctctggaactcggggcccgacctggtggtgccgcggttccacacgcccagcgtctacttcttccgccgcgaggacgcggacgggaacgacctggcgggcgcggacgggagcttcttcgacggggcgcggatgcggcgcgcgctggccgaggcgctcgtgcccttctacccgatggccggccggctggcgcgcgacgaggacggccgcgtcgagatcgactgcaacgcgggcggggtgctgttccaggaggcggacgcgcccgacgccaccatcgactacttcggcgacttcgcgcccaccatggagctcaagcgcctcatccccaccgtcgacttcacggacgacatctcctccttcccgctgctcgtgctccaggtgacccacttcaagtgcggtggcgtggctatcggcgttggcatgcagcaccacgtagccgacggcttctccggcctgcacttcatcaactcgtgggcggacctctgccgcggcgtcccgatcgccgtcatgcccttcattgaccgctcgctcctccgcgcgcgcgatccgccgaccccggcctacccgcacatcgagtaccagccggcgcccgccatgctatctgagccgccacaggcggccctcacgtccaagccggcgacgccgcccacagccgtggctatcttcaagctctcccgcgccgagctcgtccgcctccgttcgcaggtccccgcgcgcgagggcgcgccgcggttcagcacgtacgctgtgctggcggcgcacgtgtggcggtgcgcgtccctggcgcgcggcctgccggccgaccagcccaccaagctgtactgcgccacggacgggcggcagcggctgcagccgccgcttccggagggctacttcggcaacgtgatcttcacggcgacgccgctggccaacgccggcacggtgacggccggggtggcagagggcgcgtccgtgatccaggccgcgttggaccggatggacgacgggtactgccggtcagcgctggactacctggagctgcagccggacctgtcggcgctggtccgcggggcgcacacgttccggtgccccaacctggggctcaccagctgggtgcgcctgcccatccacgacgcggacttcgggtgggggcggcccgtgttcatgggccccggcggcatcgcctacgaggggctcgcgttcgtgctccccagcgccaaccgcgacggcagcctgtccgtggccatctcgctgcaggcggagcacatggagaagttccggaagctcatctacgacttctgatctccaactcctccccacaagtcatcagtaccagtacgcgcaacacaaagaagcaagagaccgttgggagtaggttgcagcaatattctttgatttcacacatagttcctgcacacttttccgttcctgcctgccccctttgggcagggcgcataccttttgtgccgaattatttacgagcccctgcaattgtatgatgaatgaacaatgaatgatacagattaataagattaattaacttaaaaaaaaaaaaaaaaa

SEQ ID NO: 152 - protein, 446 aa, Zea mays
MKITVRGSEMVYPAAETPRRRLWNSGPDLVVPRFHTPSVYFFRREDADGNDLAGADGSFFDGARMRRALAEALVPFYPMAGRLARDEDGRVEIDCNAGGVLFQEADAPDATIDYFGDFAPTMELKRLIPTVDFTDDISSFPLLVLQVTHFKCGGVAIGVGMQHHVADGFSGLHFINSWADLCRGVPIAVMPFIDRSLLRARDPPTPAYPHIEYQPAPAMLSEPPQAALTSKPATPPTAVAIFKLSRAELVRLRSQVPAREGAPRFSTYAVLAAHVWRCASLARGLPADQPTKLYCATDGRQRLQPPLPEGYFGNVIFTATPLANAGTVTAGVAEGASVIQAALDRMDDGYCRSALDYLELQPDLSALVRGAHTFRCPNLGLTSWVRLPIHDADFGWGRPVFMGPGGIAYEGLAFVLPSANRDGSLSVAISLQAEHMEKFRKLIYDF

SEQ ID NO: 153 - DNA, 1843 bp, Zea mays
gcgggcgactggcctaaaatcgcctcttgtttgtttgcttccgtcgtcccctctccacgtagagcacgcccccggaccaccttttataagcaccaaccatctggccttgccgcgccgattcgccacgaagccgcactgtgagagagggacgcggcctgttgtcccggcttttagacgcaacttccatcgctgcgaagctatccattcgtgttcgtcatggccgccagcgtcaccgtggaaaacctcaaccccaaggtcttaaaatgtgagtatgcagtccgtggggagattgtcatccatgctcagcgcctgcagcaacaactacaaacacaaccagggtctcttccttttgatgagatcctctattgcaatattgggaatccccaatctcttggtcagcaacctgtgacattcttcagggaggttcttgctctttgtgattatccgtgcctcttggaaaaagaggaaaccaaatcattgttcagtgctgatgcaatttctcgagcaaagcagattcttgcaactattcctggaagggcaacaggtgcatatagtcacagtcagggtatcaaaggactgcgtgatgcaattgctgctggaatcatgtcacgtgatggattccctgcaaatgcagatgacattttcattacagacggagcaagtcctggggtccacatgatgatgcaattactgattaggaatgagaaagatggcattctgtgcccaattcctcagtaccccttgtactcagcctccatagctcttcatggtggagctcttgtcccctattaccttaatgaaaaaactgggtggggtttggagatctctgatcttaagatgcaactggaaaatgctcggtcaaaaggcattgatgttagggctttggtggttatcaatccaggaaatccgactgggcaggttcttgctgaagacaaccaatatgatatagtgaaattctgcaaaaatgagggccttgttcttctagctgatgaggtatatcaagagaacatctatgtggacaacaagaaatttaactctttcaagaagattgtaagatccatggggtatggcgaggatgatctccctctagtatcgttacagtctgtttccaaaggatactatggagagtgtggtaaaagaggagggtacatggagattactggcttcagtactccagtaagagagcagatctacaagatagcttcagtgaacctgtgctccaatatcactggtcaaatccttgcgagcctcgtcatgaatccaccaaaggttggagacgaatcatatgcttcctacaaggcagagaaagatggaatccttgagtctttagctcgtcgtgcaaaggcgttggaggatgcattcaacaagcttgagggattttcatgtaacaaggccgaaggagcaatgtatcttttccctcagattcatctgccacagaaggcaatcgaggctgctaaagctgctaagaaagcgcctgacgctttctacgctctccgtctccttgaatcaactggaatcgtcgtggtccctggatctggatttcgtcaagttcctggaacatggcacatcagatgcacgatcctgccgcaggaagacaagatccccgcggtgatcagccgcttcagggctttccatgaggcgttcttggccgaataccgcgactaaactgttacgctgtgtgtgagttaagttggaggttcagtagaactgtagaagagctcagtgacagcgcagaaagaggcagtgttagaaaggcttaggtccttcttcacaggagcaacagttgtctccatcaaggagaaataaaaattttagttttacaacttctcaaaaaaaaaaaaaa

SEQ ID NO: 154 - protein, 482 aa, Zea mays
MAASVTVENLNPKVLKCEYAVRGEIVIHAQRLQQQLQTQPGSLPFDEILYCNIGNPQSLGQQPVTFFREVLALCDYPCLLEKEETKSLFSADAISRAKQILATIPGRATGAYSHSQGIKGLRDAIAAGIMSRDGFPANADDIFITDGASPGVHMMMQLLIRNEKDGILCPIPQYPLYSASIALHGGALVPYYLNEKTGWGLEISDLKMQLENARSKGIDVRALVVINPGNPTGQVLAEDNQYDIVKFCKNEGLVLLADEVYQENIYVDNKKFNSFKKIVRSMGYGEDDLPLVSLQSVSKGYYGECGKRGGYMEITGFSTPVREQIYKIASVNLCSNITGQILASLVMNPPKVGDESYASYKAEKDGILESLARRAKALEDAFNKLEGFSCNKAEGAMYLFPQIHLPQKAIEAAKAAKKAPDAFYALRLLESTGIVVVPGSGFRQVPGTWHIRCTILPQEDKIPAVISRFRAFHEAFLAEYRD

SEQ ID NO: 155 - DNA, 1170 bp, Zea mays
gcgggtcgcaatcaaggctgctcccctctatctccgtgttcgcccctcggttcaccacccgccgccgccgagacctcctcctcgccggctactcctgaccccataaaggcagcgctcggaggtggccctctgtcgggtggagtggtggacacatccgcgcccatggccaaccgcggcgctgcggccggcaagctcaccgtcgccgagacattctccaacctcagggagcaaggcaagagtgcattcatcccgttcatcactgctggtgatcctgacctggcaaccacatcaaaagcattgaagattctcaattcctgcggttcggatgttatagaggttggcgtaccatactcggatccactggctgatggaccagttattcaggcttctgcaacacgggcgcttaagaaaggcactacactcgattctgtcatagaaatgctgaagggggttacacctgagctttcttgccccattgttcttttcacatactataatccaattctgaaacgtggtgtgggaaacttcatgtcttttatcaaacaagctggcatacatggacttgtagtgcctgatcttcccttggaggagacagcgttgctgaggagcgaggccattatgcacaacatagagctggtgctgcttacaacgccaaccacgccaacagatcggatgaagggaattgcacaagcttcagaaggatttctctatcttgtgagcgctgaaggggttacaggtgcacgctcaaatgtaaacttacgtgtagaacaccttcttagggagatcaagaaggttacagacaaaccggtagctgttggtttcggtgtatcgactccagagcatgtgaaacagatcgtgggctggggagcggacggtgtgattgttggcagtgcgattgtgaggcagttgtgtgaggctgctactcctgaagagggtctggaaaggctcgaggagtacgccaggagtatgaaggctgctatgccgtgagctgatctcactccccgtcacaggcaaggtaaatagaacatggttttagcaatattctgggcatgggtttggcatccagaactcatcttagtgctgtacgggtcgttctcgggtggtgagaacgaagtctggctttgcctataatagaaaagggttaaactgagttaaaaaaaaaaaaaaaaa

SEQ ID NO: 156 - protein, 274 aa, Zea mays
MANRGAAAGKLTVAETFSNLREQGKSAFIPFITAGDPDLATTSKALKILNSCGSDVIEVGVPYSDPLADGPVIQASATRALKKGTTLDSVIEMLKGVTPELSCPIVLFTYYNPILKRGVGNFMSFIKQAGIHGLVVPDLPLEETALLRSEAIMHNIELVLLTTPTTPTDRMKGIAQASEGFLYLVSAEGVTGARSNVNLRVEHLLREIKKVTDKPVAVGFGVSTPEHVKQIVGWGADGVIVGSAIVRQLCEAATPEEGLERLEEYARSMKAAMP

SEQ ID NO: 157 - DNA, 1565 bp, Zea mays
gggcggactcgtggggtctttggactcgctgctgttcttttgcttgggaggagttggtgagcgaactcgggatcagtgggtgaccgcagagttcttgcttcttcctcttggaggaggagggctgcagcctgcaggggccggagagagcaggaggaggcggagacatgggtagcttcgctaagctggcgaggagggcggtggagacggacgctccggtcatggtgaagatacaagaactgctccgaggggccaaggatgtgatgtcgcttgcgcagggagttgtttactggcaacctcccgagtcagctatggataagatcgaaaagatcatcagggaaccaatagtcagtaaatatggttctgatgatgggcttcctgagcttcgagaagcacttctcgaaaagctaagcagagagaataagcttaccaaatcatcagtcatggtcactgctggtgcaaatcaggcttttgtgaacttggtcctcactctctgtgatgctggtgattccgttgtcatgtttgcaccgtattatttcaatgcctacatgtcattccagatgacaggtgttactgacatattagttggtggttgcgattccaggacacttcatcatgatgttgattggttggagaaggttctgaaagaaaatgagcctatccctaaacttgtcactgttgtgaatccggggaacccctctggagcttttattccaaggcctatgcttgagaggatttcagatctgtgcaaaaatgctggtgcatggcttgtggttgacaatacctatgagtactttatgtatgatggaatggagcactactgcttagaagatgctcatattgtcaacctcttctcgttctcaaaggcttatggaatgatggggtggcgtgtaggatacattgcatttccaaatgaagctgatggcttccacgatcagctcctcaaagtgcaagacaacataccgatctgcgcctccatcatcgggcagcgcctggcgctctactcgctggaggccggccccgagtggatcaaagaacgggtgaaagacctggtgaaaaaccgagcgctgctggtggaggcgctgtccccgctcggcgaggacaacgtcaagggcggggagggcgccatctacctctgggcaaagctaccggacagctgctcggacgacttcgaggctgtgaggtggctcgcgaacaagcacggcgtcgccgtgatccccgggagcgccagcggaggccccgggtacatccgcgtctccttcggagggctcaaggaagaagacaccaggctggctgctgagaggctcaggcgcggcctgcaggagctggtgaccgatggaatggtaaagtgacggctccatgggtgtaagtaaaagctccaattttccaacggtgtaattccgccgtgattaattcgggagaagaaaaggaacttgttttcaagaatgcactgcgttgctcggacgagagacgggacggaataaaatgcgtctggtctgcagagtcacctatgttatgaatcatatgtagtgcatatatcatgataaaaaaaaaaaaaaaaaaaaaaa

SEQ ID NO: 158 - protein, 394 aa, Zea mays
MGSFAKLARRAVETDAPVMVKIQELLRGAKDVMSLAQGVVYWQPPESAMDKIEKIIREPIVSKYGSDDGLPELREALLEKLSRENKLTKSSVMVTAGANQAFVNLVLTLCDAGDSVVMFAPYYFNAYMSFQMTGVTDILVGGCDSRTLHHDVDWLEKVLKENEPIPKLVTVVNPGNPSGAFIPRPMLERISDLCKNAGAWLVVDNTYEYFMYDGMEHYCLEDAHIVNLFSFSKAYGMMGWRVGYIAFPNEADGFHDQLLKVQDNIPICASIIGQRLALYSLEAGPEWIKERVKDLVKNRALLVEALSPLGEDNVKGGEGAIYLWAKLPDSCSDDFEAVRWLANKHGVAVIPGSASGGPGYIRVSFGGLKEEDTRLAAERLRRGLQELVTDGMVK

SEQ ID NO: 159 - DNA, 1637 bp, Zea mays
ccccgcgcatcgccatggctctcgccgtccgcacgcctcgcttccagcctcgaccggcctccatttctgcgcccacaacacccgcatcgacctccctcgccgccgggaacgcgaggccccgcccctgcgccggcgccgccgttcgcgcctcgcccttcaccgaggccacctcctcctcgcgctaccgccgcgacgcctggtcatacgccgccgatggctcctccaactccgcatccccgtcctccgctgccgctgctgccgcgggccgtcgggatgacgagatcgcgctgcagctgccggaactgcggaggctcctggacgtgctgagggcgtccagggggaggggcgccgaggagggcggcggacccggggaggtggcactggtgggcacagggcccggggaccccgagctgctcacgctcaaggcggtccgggccatcgaggcggcggacctggtgctctacgacaggctggtgtctaacgacgtgttggacttggtcggggagggcgccaggctgctctatgtcggcaagaccgcgggataccacagccgcacccaggaggagattcacgagctgctgctgagctttgcggaggccggtgccaatgttgtgcgcttgaaaggtggcgatcctctggtttttggaaggggtggagaagagatggatttcttacagcaacagggaattaaagttgaagttatcccaggaattacttctgcttcgggtattgcagcagagctaggcattccgttaacccatagaggtgttgctaccagtgtcagatttttaactggccactccagaaatggtgggacagatccactatatgtagctggaaatgcggctgatccagacactactttggttgtgtatatgggtttgtcaacacttccatcacttgctccaaagttaatgaagcacggcctgccaccagatacccctgctgttgcagtagagcgcgggactacaccccaacaacgaacggtgttcgcctcgttgaaggatcttgtggatgaagtcaagtcagccgatctagtttctccaactctaataattattgggaaagtggtatccttgtcacccttctgggttgagtcatctgaacatgatgcactgaaagttcagagctcgtatgcaaatgaggcagatgacaacagattttcttggtttttagtgactggacaatacttgagaaatgcaagatcccagatatgggagcacaggttcgacctggtgtacacagaaacatctcaggaagcatggatcctgaatggcggatggtagcttaagcttataacagacttggggcagaagcgcacttggactgatcatgcttgattctttggcctaatctacatgagattcacaatttttcgatttagttgagttcgacaatagttgtgtgcttctttgttactagtagccatgtacgtgcggcgcagcggtgtttacgattctatgccctagcatagtaaggctattccaacgctgccacgttatgattttatgataatgggagtttcgtagcaccatgataatgagaaatagtgctacgaagctcttattatatgacaagtgccataaatcgtagcacttatgattttatgatatggggagcttcgtagagctctttct

SEQ ID NO: 160 - protein, 423 aa, Zea mays
MALAVRTPRFQPRPASISAPTTPASTSLAAGNARPRPCAGAAVRASPFTEATSSSRYRRDAWSYAADGSSNSASPSSAAAAAAGRRDDEIALQLPELRRLLDVLRASRGRGAEEGGGPGEVALVGTGPGDPELLTLKAVRAIEAADLVLYDRLVSNDVLDLVGEGARLLYVGKTAGYHSRTQEEIHELLLSFAEAGANVVRLKGGDPLVFGRGGEEMDFLQQQGIKVEVIPGITSASGIAAELGIPLTHRGVATSVRFLTGHSRNGGTDPLYVAGNAADPDTTLVVYMGLSTLPSLAPKLMKHGLPPDTPAVAVERGTTPQQRTVFASLKDLVDEVKSADLVSPTLIIIGKVVSLSPFWVESSEHDALKVQSSYANEADDNRFSWFLVTGQYLRNARSQIWEHRFDLVYTETSQEAWILNGGW

SEQ ID NO: 161 - DNA, 1366 bp, Zea mays
gcgtccacagaatttcacgcatcgcacggggaacaccgatcgatcgatccctcgagaagcagagacaagtagcccgcccgcccgcccgcacacatagagacagagagaatcaagccgccgccgaccagtgacatggcgccctgggccattgccatccacggcggcgcgggcgtggacccgaacctcccggagcaccggcaggaggaggcgaagcgcgtgctggcgcggtgcctgcaggtgggcgtggacctgctgcgcgcgggcgcgcaggcgctggacgtcgtggaggccgtggtgcgcgagctggagacggaccccttcttcaactcggggcgcgggtccgcgctcacccgcgccggcaccgtggagatggaggccagcatcatggacggccgcggccgccgctgcggcgccgtgtccggcgtctccaccgtcaagaaccccgtgtccctggcgcgccgcgtcatggacaactcgccccactcgtacctcgccttcgacggcgccgaggagttcgcccgtgcgcagggcctggagaccgtggacaacagctacttcatcacggatgacaacgtcggcatgctcaagctcgccaaggaggccggcagcatcctgttcgactaccggatcccgctggcggggacggacacgtgcagcgcgctggcgggcgcggcggacagcaacggcggcggcgtgcacaaggcggggatggtcatgaacgggctgcccatcagcgtgtacgcgccggagacggtggggtgcgcggtggtggacgcgacgggggcctgcgcggcggccacgtccacgggcgggctcatgaacaagatggccggccgcatcggggactcgccgctcatcggctccggcacctacgcgtgcggcgcctgcgccgtgtcgtgcacgggcgagggcgaggccatcatccgctgcacgctcgcgcgcgacgtggccgccgtcatggagtacaagggcctgcccctgcagcaggccgtcgactactgcgtcaaggagcgcctcgaccagggattcgccggcctcatcgccgtctccggcaccggcgaggtggcgtacggattcaactgcaccggcatgttccggggctgcgccaccgaggacgggttcatggaggtcggcatctgggagtgagctggaggccccgccatctaaacacaaatcaaaatcagtgtgcgtgcagctgcatgtggccatcctgcgattgccatgtgtttaatctccgggtcacaggtgttgtcgatgatccaccactagtagtagcgattgcatggagattggtgctcgggtcaataatgatggtgattgtgacggagtgccctgcaaaataattaataattcgtgtgaaaaagtt

SEQ ID NO: 162 - protein, 337 aa, Zea mays
MAPWAIAIHGGAGVDPNLPEHRQEEAKRVLARCLQVGVDLLRAGAQALDVVEAVVRELETDPFFNSGRGSALTRAGTVEMEASIMDGRGRRCGAVSGVSTVKNPVSLARRVMDNSPHSYLAFDGAEEFARAQGLETVDNSYFITDDNVGMLKLAKEAGSILFDYRIPLAGTDTCSALAGAADSNGGGVHKAGMVMNGLPISVYAPETVGCAVVDATGACAAATSTGGLMNKMAGRIGDSPLIGSGTYACGACAVSCTGEGEAIIRCTLARDVAAVMEYKGLPLQQAVDYCVKERLDQGFAGLIAVSGTGEVAYGFNCTGMFRGCATEDGFMEVGIWE

SEQ ID NO: 163 - DNA, 1299 bp, Zea mays
gagcggtgagccgcggccgccccgcgaagagaggtgacgcggcgagcacacggccatagaggttactgctctcctgggctgtgaggctgtgaggctgtgaccaaacgctctacgctcccacttcccaccaactcccaaatcctccctgaaaataagaatacgagggtgagcgatcgagcggtcgagggggttgtgcttgtgcgtcagatcaaccgactggtggcgaggctgcgggaggagatggccggcgaagggaatggggatgaagggtggaggcggagcggcatcgaggtcagcgccctgcagttcggctacgacgggcagccgccgctcttcgcgcgcttcaacctctgcgtcgcacccggctcccgctgcctcctcgtcggcgccaacggatcaggcaagaccacactcttgaagattcttgcgggaaagcatatggttggaggaagagatgtggtccgtgtcctcaatggttccgcttttcatgatacacagctagtgtgcaatggtgacctttcgtacttgggtggttcttggagccgtactattggttcagctggggatgttccactgcaaggcgacttctctgctgagcacatgatttttggagttgatggggttgatcctgtcaggcgagagaagctggttgatctgctagacattgatctgcagtggcgcatgcataaagtttcagatgggcagcgccgcagggtgcaaatctgcatgggtcttcttcatccatacaaggtgcttttgctcgatgagatcacggttgatctggacgtggtgaccaggatggacctgcttggtttcttcaaggaagagtgcgagcagagggaagctaccatcgtgtacgccacccatatatttgacggactcgagacgtgggctaccgactttgcgtacatccaagaaggcgagctgagaaggtccgggagatactccgacatcgaggagctaaggagcgccaagaacttgctgtcggtagtcgagtcgtggctgaggtcagagaccaaactcccgaagaaggaacccccaccacgtcctgagacccaggccaggcgttcctcgccgttcgatgcttctcctttccgttcgtcacgccacatggcctactaccgttgatggtttcccaactcgtactacaccattgcctcttgttctgcgctatatatatatatttttgttgtcgctcatatcgtatagtagctgtggagtttaatatgtgtcctcttcacggcccttgtagacatcaatcaatatatagcaggcagcacagaaataaaagtttggttc

SEQ ID NO: 164 - protein, 295 aa, Zea mays
MAGEGNGDEGWRRSGIEVSALQFGYDGQPPLFARFNLCVAPGSRCLLVGANGSGKTTLLKILAGKHMVGGRDVVRVLNGSAFHDTQLVCNGDLSYLGGSWSRTIGSAGDVPLQGDFSAEHMIFGVDGVDPVRREKLVDLLDIDLQWRMHKVSDGQRRRVQICMGLLHPYKVLLLDEITVDLDVVTRMDLLGFFKEECEQREATIVYATHIFDGLETWATDFAYIQEGELRRSGRYSDIEELRSAKNLLSVVESWLRSETKLPKKEPPPRPETQARRSSPFDASPFRSSRHMAYYR

SEQ ID NO: 165 - DNA, 2005 bp, Zea mays
ccccctctcccatcgacttcctccgtcgtccgtcgcactgccacggatcaccctcttccttcgtcttcctccacaaaacctacagcgctggtgcgccgaggagctagctagctagcccggccggccggccggcgccatgcctcccgtgaaggccgaggacctggttgtgcacgccgtcaaggagcagttcgccggcctcgactactgcatcaccagccccccgccatggatcacgacggtgctcgttggcttccagcactacctggtcatgctcggcaccaccgtcctcatcgccaccatcatcgtcccgctcatgggcggcggccatgccgagaaggcgatcgtgatccagaccatcctgttcctctccgggatcaacacgctgctgcaggtccacttcggcacgcggctccccgccgtgatgagcggctcctacacctacatctacccggccgtggccatcatcctgagcccgcgatacgcgctcctcatcgaccctctcgagagattcgtgttcacgatgaggtcgctccagggcgcgctcatcatcgccggcgtcttccaggccgtcgtcggcttcttcggcatatggagagtctttattaggttcctgagccccctcgcggcggtccccttcgtcacgctcacgggcctgggactcttcttcttcgcgttccccggggtcaccaagtgcatcgaagtgggtctccccgcccttgtcctcctggtgatcttcgcagagtacgcctcccacctgttcgctaaggggagcttcgtgttcagccggtgcgccgtgctggtgaccgtcgtgatcatctggatctacgccgagatcctgacggcggccggcgcctacaacgagaggggccctgtgacgcagttcagctgccgcgccgaccgctccgggatcatccagggctcaccttgggtgaggtttccttatccgttccagtggggataccccattttctgcttccaggattgcttcgccatgctggcggcttcttttgcgtcgcttattgagtctaccggcaccttaatcgcagtgtcaagatactcaggcgcgacgttctgcccaccctccgtcttctcacgtggaattggctgggagggtatatctatcatactggacgggatgtgcggtacactgacaggaacagcggcttcagttgagaatgcaggtctactggcagtgacgcgagttggaagccggcgagtcattaagatctcagccttgttcatgattttcttctccttgtttgccaaatttggggcggttcttgcatccattccattgcctattttcgctgcactgtactgcgtcctcttcgcttattcagctggtgcaggcttcagcttactccagtactgcaacctcaactccttgaggacaaagttcatactcagcatctcgttgttcctggggctgtccatcccacagtacttccgggtctacgagatgttcttcggcttcggaccagttcacacccattcagtagcgttcaacgtgatggtcaatgtcatcttctcatcgccggcgacggtggccgccatactggcctaccttctggactgcacccacctgtactgggaggctagtgtgaagaaggacaggggctggttctggtgggagaagttcaagtcctacaagtatgatggcaggagcgaggagttctaccgtcttccttatggcttgagcaggtacttcccctcgctctaggacgccgggaggaagacgacggacccaagttctatgtagctgctcgagcgtagaagctgaacatcagttgaaggcaacagaaccatatgttattttcatatatcaagcagttgggagggagcttgatgttttgatttaccttgtaaaacattttggatgataaacttttgcaattactgggagagtaggatcaaccaggggagaattctgcaacaattcagtcaccgtttttgcttcagattcgaaacagaacacagatgccttcacaggcttcgattattttcc

SEQ ID NO: 166 - protein, 527 aa, Zea mays
MPPVKAEDLVVHAVKEQFAGLDYCITSPPPWITTVLVGFQHYLVMLGTTVLIATIIVPLMGGGHAEKAIVIQTILFLSGINTLLQVHFGTRLPAVMSGSYTYIYPAVAIILSPRYALLIDPLERFVFTMRSLQGALIIAGVFQAVVGFFGIWRVFIRFLSPLAAVPFVTLTGLGLFFFAFPGVTKCIEVGLPALVLLVIFAEYASHLFAKGSFVFSRCAVLVTVVIIWIYAEILTAAGAYNERGPVTQFSCRADRSGIIQGSPWVRFPYPFQWGYPIFCFQDCFAMLAASFASLIESTGTLIAVSRYSGATFCPPSVFSRGIGWEGISIILDGMCGTLTGTAASVENAGLLAVTRVGSRRVIKISALFMIFFSLFAKFGAVLASIPLPIFAALYCVLFAYSAGAGFSLLQYCNLNSLRTKFILSISLFLGLSIPQYFRVYEMFFGFGPVHTHSVAFNVMVNVIFSSPATVAAILAYLLDCTHLYWEASVKKDRGWFWWEKFKSYKYDGRSEEFYRLPYGLSRYFPSL

SEQ ID NO: 167 - DNA, 894 bp, Zea mays
  misc_feature 336, 854, 855, 884, 885: n = A,T,C or G
gagagggcaggcaagaaccgagcaaatcagggcagcaggtgcctgctgccaagtcttggtcttggtcttggtgcgctgtgtaaagacgactcagccatggaggggtcgacggcgaccgagggtcatgtggtcgggatcccggtgagcacaagggcttatggcatcgaggaacccgacttctcggtagaagagacgacgcccgaccgtggagagttcccgagctccttccagtactacagccatgatgctgccagttcgacgacgaccgccgccgatcggccgacgagcaatcaacaagccactaggaagggagacaagatcgtccggggcatcaangaacatgtgaccctgggaccgaagctctccgacacggtgaaggggaagctctcgctgggcgcgaagatcctccgggccggcggcagcgtggagaagctgttccggcagtggttctcggcggacaaggacgagaagctgctgcgggcgtcgcagtgccacctgtggacgacggcggggcccatcgccggcgtgctgttcgtgtcgacggcgcgggtggccttccgcagcgaccggtcgctgtcgctggcggtgtccaccccgcgcggcgactgcagcttccgcgcgccgtacaaggtggccgtcccgctgcggaaggtcggggcggtgcggcccagcgagaacaggcaccggccggagcagaggtacgtgcggctcgccaccaccgacggcttcgagttctggttcatgggcttcgtcagctacaacaagtcgctgcagcacctggagcgggccgttgcgtgcgcgcggcaggcgcggtgacggtgtgctagttctgggccgggctctgtatgtgtagnntgcagctgcaacatgtcgttgtacatctnngcgatcggt

SEQ ID NO: 168 - protein, 229 aa, Zea mays
  VARIANT 80: Xaa = Any Amino Acid
MEGSTATEGHVVGIPVSTRAYGIEEPDFSVEETTPDRGEFPSSFQYYSHDAASSTTTAADRPTSNQQATRKGDKIVRGIXEHVTLGPKLSDTVKGKLSLGAKILRAGGSVEKLFRQWFSADKDEKLLRASQCHLWTTAGPIAGVLFVSTARVAFRSDRSLSLAVSTPRGDCSFRAPYKVAVPLRKVGAVRPSENRHRPEQRYVRLATTDGFEFWFMGFVSYNKSLQHLE

SEQ ID NO: 169 - DNA, 1978 bp, Zea mays
cgaaggtggagctgacctgaccggctgacccgcccaacccaacaacctctccgctggccatcttcctcccgggatccctctccctccttcgatccagctcagctctcttcctcccgccccgtactcttcttgatccgttcactcatacttctcgagagaaaaggaagaggattcgatctgttgctaccgctagctgcggtactaacagcagcagcagcaacaggaggtaccgtagaagaagggaagggaatccatgaagagatggggcagcagcggacaggccgccgattccttctaccaggtccgccccgattgcagccaaaacgtccccaacaccaagttcaagatcaaggcggggaagacactgagcgttaggaaatggcatgctgcgttcacgcgtgatggatgcctggatatcgcctctgttctgagccgcatacagagagggggtgtgcaccccacgatcaggggagaggtttgggagttcttgctcggctgctttgaccctgggagcaccttcgatgagagggaccagattagggagcggagaaggatgcagtatgccagatggaaggaagaatgcaaagagatggattctcatgtcggcagtggtaaaatcatcaccgccccgattataactgaggatggattccctattaaggatccgttggtattacttgaggctacttcagacacgcaaggtacttcaatcgccaccggcaacagtggaaatggaattgagaaccgtgtcttggataaacaaattattgactggaagcttaccttacatcaaataggccttgatgttctgcgcactgaccgcaccatggtattttatgagaacaaagataacatttcaaagttgtgggatattcttgctgtctatgcatggatcgacaaagaagttggttattgtcaaggaatgagtgatttatgttcacccatgatagtgctactccacaatgaagcagatgcattttggtgctttgagagattgatgcgtagactgcgaggtaatttcagatgcacacaacagtctgttggggtggaaaaccagcttcagcatcttgcttctatcattcaggtgcttgatccaaagttacatggccacctagaaagacttggcgggggtgactatctcttcgcattccgcatgttcatggtattgttccggcgagaactatcatttggggactccttgtacctttgggagatgatgtgggctctcgaatatgatcctggcatttgctccacttatgaagaggataatactggggctgtggtccacaaaattgaaggaaaggtaaaatcaatacgtcagtttggtaagtacgagagggagaatatgaagaagagggcaaacgatggtgatggacctgtccctatttcggtcttcctggttgctagtgtcctaaaagagaacagtacaaagcttctgcaagaggctcgagggattgatgacattattaggatattgaataatgttaatggaaatctggacgccaaaagagcttgcgttgttgcactaaagcttcataggaagtatcacaaaaagttgcaggaaaagaaatcctaacatcatatggcgagattgcacgcaacacaacactgggacttatatattgcttgtttctgttcctttcattttcccactcactgtatcggaggaagaaggtggtttacatatacagtcgcgggcgagacctcataaatataagtgacttattgtatctacaatatcaatgatccacgtccacagcctactcaattgtgaacatcaacctagtacatgataatttattcacgatcacaatggacttggcaaatattatcccatcagtatttgtcatgaacctcagtctactctcgtatcatcttaggtttttggatcccttcgttttgaaggaactgaaatttacttaatggagtaggttacttggtttaaaaaaaaaaaaaaaaaaaaaaaaaaaaaaaaaaa

SEQ ID NO: 170 - protein, 439 aa, Zea mays
MKRWGSSGQAADSFYQVRPDCSQNVPNTKFKIKAGKTLSVRKWHAAFTRDGCLDIASVLSRIQRGGVHPTIRGEVWEFLLGCFDPGSTFDERDQIRERRRMQYARWKEECKEMDSHVGSGKIITAPIITEDGFPIKDPLVLLEATSDTQGTSIATGNSGNGIENRVLDKQIIDWKLTLHQIGLDVLRTDRTMVFYENKDNISKLWDILAVYAWIDKEVGYCQGMSDLCSPMIVLLHNEADAFWCFERLMRRLRGNFRCTQQSVGVENQLQHLASIIQVLDPKLHGHLERLGGGDYLFAFRMFMVLFRRELSFGDSLYLWEMMWALEYDPGICSTYEEDNTGAVVHKIEGKVKSIRQFGKYERENMKKRANDGDGPVPISVFLVASVLKENSTKLLQEARGIDDIIRILNNVNGNLDAKRACVVALKLHRKYHKKLQEKK

SEQ ID NO: 171 - DNA, 3034 bp, Zea mays
attcactcacacagcaaatacccacagtccacagcaagaaccgaagatgttcggaaacatcggaaagatcccgatcatcggcgacctgacgggcagcaacaagaatgcgcacctcaagggcaacctggtgctcatgcgcaagaccgtgctcggcttcgacgtcaccagcatcgccggctccctcatggacggcctcggcgagttcctcggccgcggcgtcacctgccaactcgtcagctccaccgtcgtcgaccccaacaacgggaaccgcgggaaggtgggtcaggaggcgagcctggagcagtggctgctgcacccgccgccgcttctggccggcgaggaccagttccgcgtcaccttcgactgggaggtggagaagcacggcgtcccgggcgccatcatcgtgaagaacaaccacgcctccgagttcttcctcaagaccatcaccatcgacgacgtccccggccacggccccatcgtcttcgtcgccaactcatgggtgtacccgcagtacaagtaccgctacaaccgcgtcttcttctccaacgacacgtacctccccagccagatgccggcggcgctgaagccttaccgcgacgacgagctccgcaacctgaggggcgacgaccagcagggcccgtaccaggagcacgaccgcgtctaccgctacgacgtctacaacgacctcggcaaccccgacgccaaaaacccgcgccccgtcctcggcggctccaagcaccacccctacccgcgccggcggcccacgggccggaagccgacgcagacagaccccaacagcgagagcaggctgacgctgaccgacggcgacgtctacgtgccgcgcgacgagcgcttcggccacatcaagaactccgacttctacggctacaccatcaaggcgttcgtcgacggcctggtgcccatcctggaaggctacctcctcggcatcgagttcaactccttcaaggacatcctgcagctgtacgagggcggtatcaagctgcccgacatccccgccctcgaggagttccgcaagcagttcccgctacagatggtcaaggacctcatgcccgccggcggcgactacgtcctcaagctccccatgcccaaaatcatcaaagaggacaagaaagcttggatgagtgacgaggagttcgcaagggagaccctcgccggcgtgaaccccttgatcatcaggcgtctcacggagttccctccgaaaagcacccttgatccgagcaagtacggcgaccagacgagcaccatcacggaggcgcacatcgcggggagcctggagggcctcaccgtgcagcaggcgctggacagcaaccggctctacatcctggaccaccacgaccactacatgccgttcctgatcgaggtcaacagcctgaacgacaacttcatctacgccaccaggacgctcctgttcctgcgcggcgacggcacgctcgcgccggtggccatcgagatgagcctccccgagctccgggacggcatcacggccgcgaagagcacggtgtacacgccggcgccgccgacggccggcgcggaggcgtgggtgtggcgcctggccaaggcctacgtgaacgtgaacgactactgctggcaccagggcatcagccactggctcaacacgcacgcggtgatggagccgttcgtgatcgccaccaaccggcagctcagcgtgacgcaccccgtgcacaggctgctgctgccgcactaccgcgacaccatgaacatcaacgccctcgcgcgccagaagctcatcaacgccggcggcatcttcgagatgaccgtcttcccgcgcaagtacgccatcgagatctcctccaaagtctacggcagctggaacttcaccgagcaggccctccccgacgacctcatcaagcgaggcatggccgttccagatccgtcgagcccctacaaggtgcggctgctgatcgaggactacccgtacgcctcggacgggctggccgtgtggcacgccatcgagcagtgggtgacggagtacctggccatctactaccccaacgacggcgtgctgcaggccgacgtggagctgcaggcgtggtggaaggaggcgcgcgaggtcgggcacgccgacctcaaggacgagcactggtggcccaagatgcagacggtgccggagctcgtgaaggcctgcaccaccatcatctggatcgcgtcggcgctacacgctgccgtcaacttcgggcagtacccgtactgcgggtaccacccgaaccggccgtccgtgagccggcggcccatgccggtgccgggctccgacgcgtacaaggagctggagaagaacccggagaagttcttcgtgcgctccatcaccgcccagttccaggccgtcgtcggcatctcgctgctggagatcctgtccagccactcctccgacgaggtgtacctcggccagcgcgacaccaaggagtggacgtcggacgccaaggcgcaggaggcgttcaagcggttcggcgcgcggctgaccgagatcgagaaacgcgtggaggccatgaacaaggacccgcgcttcaagaaccgctacagcgcggcccagttcccctacaccctgctcttccccaacacctccgacaagggcgataacaccggcgtcaccgccaagggcatccccaacagcatttccatctgattcgatcgagtcctggccagcgtttcacccaaaaaagcagagctagcggtgattcccgtatgtcatccgtttcattttttacatgaatgagaagcgtggtaataaaaaggtttgtagttgcgtgcgcgccgtgtattccttggtgtactggtgctggcggtaaccacttattaccagggatccttgtaatttttcctgttggtttcccaataataatgtgaatatattggtcacatgcatggtgtttccaaaaattttttagctaattacttttttatgttttgaactagtcagttgcccgtgttatattacagttgttatatattatataaatagataatgagatatttatttaaaaaaaaaaaaaaaaaa

SEQ ID NO: 172 - protein, 871 aa, Zea mays
MFGNIGKIPIIGDLTGSNKNAHLKGNLVLMRKTVLGFDVTSIAGSLMDGLGEFLGRGVTCQLVSSTVVDPNNGNRGKVGQEASLEQWLLHPPPLLAGEDQFRVTFDWEVEKHGVPGAIIVKNNHASEFFLKTITIDDVPGHGPIVFVANSWVYPQYKYRYNRVFFSNDTYLPSQMPAALKPYRDDELRNLRGDDQQGPYQEHDRVYRYDVYNDLGNPDAKNPRPVLGGSKHHPYPRRRPTGRKPTQTDPNSESRLTLTDGDVYVPRDERFGHIKNSDFYGYTIKAFVDGLVPILEGYLLGIEFNSFKDILQLYEGGIKLPDIPALEEFRKQFPLQMVKDLMPAGGDYVLKLPMPKIIKEDKKAWMSDEEFARETLAGVNPLIIRRLTEFPPKSTLDPSKYGDQTSTITEAHIAGSLEGLTVQQALDSNRLYILDHHDHYMPFLIEVNSLNDNFIYATRTLLFLRGDGTLAPVAIEMSLPELRDGITAAKSTVYTPAPPTAGAEAWVWRLAKAYVNVNDYCWHQGISHWLNTHAVMEPFVIATNRQLSVTHPVHRLLLPHYRDTMNINALARQKLINAGGIFEMTVFPRKYAIEISSKVYGSWNFTEQALPDDLIKRGMAVPDPSSPYKVRLLIEDYPYASDGLAVWHAIEQWVTEYLAIYYPNDGVLQADVELQAWWKEAREVGHADLKDEHWWPKMQTVPELVKACTTIIWIASALHAAVNFGQYPYCGYHPNRPSVSRRPMPVPGSDAYKELEKNPEKFFVRSITAQFQAVVGISLLEILSSHSSDEVYLGQRDTKEWTSDAKAQEAFKRFGARLTEIEKRVEAMNKDPRFKNRYSAAQFPYTLLFPNTSDKGDNTGVTAKGIPNSISI

SEQ ID NO: 173 - DNA, 1106 bp, Zea mays
agccgccatgcgtgtgcccggcactgcacagcatccatcgtccatcgacccacccaacctcctcctccgccccgcgcttcgcctgggtaccggcgtccgccggccccgtaccgtctcgtccaggaacaggaagagcagtaacccatccacccatccatcggggatcaccaggggtcaggggagcaagatgtcgactgccaccgccccaagattgcccgctcccagatccggggcaagctatcactatcagacgaccgcggctccggcggccaacaccctctccttcgccggccacgcgaggcaggcggcccgcgcgtccgggccacggctgtccagcaggttcgtggcgtccgcggcggccgtgctgcacaaggtgaagctggtcggcccggacgggacggagcacgagttcgaggcccccgacgacacctacatcctcgaggcggccgagaccgccggggtggagctgcccttctcctgccgcgccgggtcctgctccacctgcgccgggaggatgtcggccggcgaggtcgaccagtcggaggggtccttcctcgacgacggccagatggccgaggggtacctcctcacctgcatctcctaccccaaggcagactgcgtcatccacacccacaaggaggaggacctgtactagagattgggttgctttatgcatcagtggttgctccaaaggtggtggtgcgttcgttgctgttccgtgccaccagcggaaggggggtttcgttgttgagatgggctagttcttgtcatcaatttcggtcattcgatgagatcatggcatatgagttgtggcaataatgctggcaatatggttttgcaattcaaactgcaaatgtgaccagcaatgtcaaaaactgcacactgtgtctgtgtgcgaacttgtgaaattggcattgagttcaattggctagttggctcgagatttcagttttcatctccatttagaggtcatttgggcctaagttggtgcttagtgtggccggatagaagcccactaaggccttgttcgtttgtgtcggattggtgggtcggaacgatttctagccggattgtttctctaatttatataaactttgattagggct

SEQ ID NO: 174 - protein, 155 aa, Zea mays
MSTATAPRLPAPRSGASYHYQTTAAPAANTLSFAGHARQAARASGPRLSSRFVASAAAVLHKVKLVGPDGTEHEFEAPDDTYILEAAETAGVELPFSCRAGSCSTCAGRMSAGEVDQSEGSFLDDGQMAEGYLLTCISYPKADCVIHTHKEEDLY

SEQ ID NO: 175 - DNA, 946 bp, Zea mays
gtgcgggcaggagcagaggctcttctcctcctcgcctcctctccctagtctccacgacgcaagggagagtgacggaaagcgacgcggcgcgagcgaggagggccaaggcgaagaggggaagcaccgcaccaggacccttgttcgccgccgccgcctctgatctccgcgaggttgtcaggattcaatatgtcgaccagcacattcgctacttcctgcacgctgttgggcaatgttagaacaacgcaggcctcccagacagcggtgaagagcccttcgtctctaagcttcttcagccaagttacgaaggttccaagcctgaagacctccaagaaactggatgtctccgccatggctgtatacaaggtgaagcttgtcgggcctgaaggtgaagagcacgagtttgatgctccagacgacgcctacatccttgacgctgccgagactgccggtgtggagttgccatactcgtgccgtgctggggcttgctccacctgtgccggcaaaatcgagtctggttcggttgaccagtcggatgggtccttccttgatgacgggcagcaggaggaaggttatgtgctgacatgcgtctcctacccaaagtccgactgcgtcatccacacccacaaggaaggcgacctgtactagggctagggctttccaatttggcgagggaccaaaaatgctctcgagtggtgtgttgtcaagcaaagctccatctgcgcgccctaccccgttgtgcgaactgtttggcatcaaacttgtgtggttgctgtcttctatgttctgctagtttatgttcggagtccgtgggaatatactagctaattaataaaaagaaaaactgatgtgatgccataatagtataatttcatggctttttgttatgtttggagaagtgatgttgtaagctattgattctgaatgccactgtggcatgctggcatcc

SEQ ID NO: 176 - protein, 152 aa, Zea mays
MSTSTFATSCTLLGNVRTTQASQTAVKSPSSLSFFSQVTKVPSLKTSKKLDVSAMAVYKVKLVGPEGEEHEFDAPDDAYILDAAETAGVELPYSCRAGACSTCAGKIESGSVDQSDGSFLDDGQQEEGYVLTCVSYPKSDCVIHTHKEGDLY

SEQ ID NO: 177 - DNA, 3173 bp, Zea mays
agacaataataccgagccctctcttccattccagccttcccaggccagctgcaactactggctcatcaccagaaaccagaacgtacgccggcaacccatctccctgaaatggccgctgtggagccccggcagttcgggcgtctggagccgggctcctcgccagtgcgcgtggccacgaacggcgccaaggcgtaccctcctccggcaagccacctcccgcggcgcgctgactcccctgtccgcggctgcagcttccctcccctcgtctccccgccgcgcaggctggacgacgcgtcggacgacgaggacgaggagcaggaggactggcgagagctgtacggctcgcacctgcagctggaggtggagcccgcggtgcaggacgcgcgcgacgaaggcaccgcggacgcgtggatcgagcggaacccgtgcctggtgaggctgacggggaagcacccgctcaactgcgagccgccgctagcgcggctgatgcaccacggcttcatcaccccggcgccgctgcactacgtgcgcaaccacggcgccgtgccgcggggggactgggcgacgtggaccgtggaggtgacgggcctcgtgaggcggcccgcgcggctcaccatggaggagctggcgcgcgacttccccgccgtggagatccccgtgacgctggcgtgcgcgggcaaccggcgcaaggagcagaacatggtgcagcagacggtgggcttcaactggggcgccgccggcgtgtccacgtccgtgtggcgcggcgcgcgcctccgcgacgtgctccgccgctgcggcatcgtgccccgcaagggcggcgccctcaacgtgtgcttcgagggcgccgaggacctccccggcggcggggggtccaagtacggcaccagcgtcacgcgcgagtgggccctggacccgtcgcgggacatcatgctcgcctacatgcagaacggcgagccgctgctgccggaccacggcttccccgtgcgcgtcatcatccccggctgcatcggtggccgcatggtcaagtggctcaagcgcatcatcgtcacccccgccgagtccgacaattactaccatttcaaggacaaccgcgtcctgccgtcgcacgtcgacgccgagctcgccaacgcagaagcgtggtggtacaagccggagtacatcatcaacgagctgaacataaactcggtgataacgacgccggggcacgacgagatcctgcccatcaacagcattaccacacagcgcggctacaccatgaaaggatacgcctactccggcggcggcaagaaggtgacgcgggtggaggtgacgctggacggcggcgagacatggctggtgtgccacctcgaccacccggagaagcccaacaagtacggcaagtactggtgctggtgcttctggtccgtcgaggtggaggtcctcgacctgctcggcgccaaggagatcgccgtgcgcgcatgggaccagtcgctcaacacccagcccgagaagctcatatggaacctcatggggatgatgaacaactgctggttcaaggtgaaggtgaacgtgtgccgtccgcacaagggcgagatcgggctggtgttcgagcacccgacgcagcccggcaaccagcccggcgggtggatggcgcggcagaagcacctggagacggcggaggcggccgcgccgggcctcaagcgcagcacgtccacgccgttcatgaacaccaccgacgtcggcaagcagttcaccatgtccgaggtgcgcaagcacgcgtcgcaggagtcggcgtggatcgccgtgcacggccacgtctacgactgcaccaagttcctcaaggaccacccgggcggcgccgacagcatcctcatcaacgccggcaccgactgcaccgaggagttcgacgccatccactccgacaaggccaaggcgctcctcgacacctaccgcatcggcgagctcatcaccacgggcaccggctacagctccgacaactccgtccacggcggctccgtcctgtcgcacctcgcgcccatccgcgaggccgtcagggcccccgcgctctccaacccgcgcgataagatccactgccgcctcgtcggcaagaaggagctgtcccgcgacgtccgcctcttccgcttctcgctgccgtcgcccgaccaggtgctcggcctccccatcggcaagcacatcttcgtctgcgccagcattgaagggaagctgtgcatgcgggcgtacacgcccacgagcatggtggacgagatcggccacttcgacctcctcgtcaaggtctacttcaagaacgagcaccccaagttccccaacggcggcctcatgacccagtacctcgactcgcttcccgtcggctcctacatcgacgtcaagggcccgcttggccacgtggagtacaccggccgcggcagcttcgtcatcaacggcaagcagcgccatgcgagccgcctcgccatgatctgcggcggaagtgggatcacgcccatgtaccagatcatccaggcggtgctgcgcgaccagccggaggaccacacggagatgcacctcgtgtacgccaaccggacggaggacgacatcctcctccgcgacgagctcgaccggtgggcggccgagtacccggacaggctcaaggtgtggtacgtcatcgaccaggtaaagcgcccggaggaggggtggaagtacagcgttgggttcgtcacggaggccgtcctgcgggagcacgttccggaaggtggggacgacacgctggcccttgcctgcggaccaccgccgatgatccagttcgccatctcgcccaacttggagaagatgaagtacgacatggccaattctttcgtcgtgttctaagaccgcgcgggcagtagccaattaataattaatttgatatacctacgacgtaccacggaccagatatatgtatataaaccagccgacttgccagcgtaaatttcgtgagatgcatgggatatcgttggaaggatactgtaaggtttgcacttgtactgtgctctagcctagaattaccagactagagcagcagataacataggccatgcatgttttgattttgccctcggaatgtgcaacatgtaaattctgagggtattgtttatttacttatgtatgctactactagcgtttaactattattgttgttaaccatcggacataaatatctc

SEQ ID NO: 178 - protein, 910 aa, Zea mays
MAAVEPRQFGRLEPGSSPVRVATNGAKAYPPPASHLPRRADSPVRGCSFPPLVSPPRRLDDASDDEDEEQEDWRELYGSHLQLEVEPAVQDARDEGTADAWIERNPCLVRLTGKHPLNCEPPLARLMHHGFITPAPLHYVRNHGAVPRGDWATWTVEVTGLVRRPARLTMEELARDFPAVEIPVTLACAGNRRKEQNMVQQTVGFNWGAAGVSTSVWRGARLRDVLRRCGIVPRKGGALNVCFEGAEDLPGGGGSKYGTSVTREWALDPSRDIMLAYMQNGEPLLPDHGFPVRVIIPGCIGGRMVKWLKRIIVTPAESDNYYHFKDNRVLPSHVDAELANAEAWWYKPEYIINELNINSVITTPGHDEILPINSITTQRGYTMKGYAYSGGGKKVTRVEVTLDGGETWLVCHLDHPEKPNKYGKYWCWCFWSVEVEVLDLLGAKEIAVRAWDQSLNTQPEKLIWNLMGMMNNCWFKVKVNVCRPHKGEIGLVFEHPTQPGNQPGGWMARQKHLETAEAAAPGLKRSTSTPFMNTTDVGKQFTMSEVRKHASQESAWIAVHGHVYDCTKFLKDHPGGADSILINAGTDCTEEFDAIHSDKAKALLDTYRIGELITTGTGYSSDNSVHGGSVLSHLAPIREAVRAPALSNPRDKIHCRLVGKKELSRDVRLFRFSLPSPDQVLGLPIGKHIFVCASIEGKLCMRAYTPTSMVDEIGHFDLLVKVYFKNEHPKFPNGGLMTQYLDSLPVGSYIDVKGPLGHVEYTGRGSFVINGKQRHASRLAMICGGSGITPMYQIIQAVLRDQPEDHTEMHLVYANRTEDDILLRDELDRWAAEYPDRLKVWYVIDQVKRPEEGWKYSVGFVTEAVLREHVPEGGDDTLALACGPPPMIQFAISPNLEKMKYDMANSFVVF

SEQ ID NO: 179 - DNA, 1663 bp, Zea mays
gttcctcctgtcatcttctcctcctcagaaacccaccaaccccgtccagccgccggctgtctcggccgccgccgccgccgccgccgccctatcccggtccttcaggcgaaccaggttggtcatggccttcaacaagatcaaggtctccaaccccgtcgtcgagatggacggcgatgagatgaccagggtgttctggaaatctatcaaggacaagcttatattccctttcgtagacctcgacatcaaatattttgacctcgggcttccacaccgtgatgctaccgacgacaaagtcacagtggaggctgcggaggccacactcaagtacaatgtggctatcaagtgtgccaccattacaccagatgaagcaagggtaaatgagtttggcttgaaggctatgtggaagagcccaaatggcacaattaggaatattctgaatggcactgtgttcagagaaccaatcatctgcaaaaacatcccacggcttgttccagggtggacaaaacccatttgcatcgggaggcatgcattcggtgatcagtaccgggcaactgatgcagttatcaaggggccagggaagcttaaattagtttttgagggaaaagaagagcaagttgagctggaggtgttcaacttcactggtgccggaggagttgccttatcaatgtacaacactgacgagtccatccatgcctttgctgacgcttctatggccactgcttatgaaaagaaatggccattgtatcttagcaccaaaaacactattttgaagaaatatgatggcaggttcaaggacattttccaggaggtgtatgaagctggttggaaaaccaaatttgaagctgccggcatatggtatgagcaccgccttatcgatgacatggtagcatacgcacttaagagtgaaggagggtatgtctgggcttgcaagaattatgatggagatgtgcagagcgatttcttagctcaaggttttggctcattgggtttgatgacttcggtactggtgtgccctgatggaaagacgatcgaagctgaagctgcccatggtactgttacccgtcattaccgtgttcaccagaaaggaggtgaaactagtacgaacagtattgcctcaatctttgcgtggacaagaggacttgcacacagggcaaagcttgatgacaatgctagactacttgacttcacccagaagcttgaggctgcctgcgttggagccgtcgagtctgggaagatgaccaaggaccttgcccttctcgttcacggatcttcaaatatcacgaggagccattacctgaacacggaggagttcattgacgctgttgctgatgagctcagatcaaggctggcagccaactcgaacctttgaaatccttgccgaagttgtggtgctttcctgcgcgacgctttcgaaccgtttttattatgtcgccattttctttccctgtgccaccaccctgatgaatgaagaaggcctgagctaggcgaacatctgcaggctgcagcagtatgccaaatcattatcattaccgttaccattaccaattggagattgccgtagatttccgcgattatgggaactcatttacctgattatctgatacgtttgaaataaaaggtcgcccattcagaatgaaaaaaaaaaaaaaaaaaaaaaaaaaaa

SEQ ID NO: 180 - protein, 412 aa, Zea mays
MAFNKIKVSNPVVEMDGDEMTRVFWKSIKDKLIFPFVDLDIKYFDLGLPHRDATDDKVTVEAAEATLKYNVAIKCATITPDEARVNEFGLKAMWKSPNGTIRNILNGTVFREPIICKNIPRLVPGWTKPICIGRHAFGDQYRATDAVIKGPGKLKLVFEGKEEQVELEVFNFTGAGGVALSMYNTDESIHAFADASMATAYEKKWPLYLSTKNTILKKYDGRFKDIFQEVYEAGWKTKFEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDDNARLLDFTQKLEAACVGAVESGKMTKDLALLVHGSSNITRSHYLNTEEFIDAVADELRSRLAAN

SEQ ID NO: 181 - DNA, 1138 bp, Zea mays
cctgtctcctcccacccttgcctccgagtcacctcctcccttggtctccgccgtcgctgcctccttgccggaaccctaaatggaccccggcgccggcgcacactactccgtccgtaccgcggaggaggttttccgcgacttccgcggccgccgcgcgggcatgatcaaggccctcaccaacgatgtggagaagttctaccagctgtgtgaccccgaaaaggaaaacttgtgcctttatggctaccccaacgaaacatgggaagtaactttgccagcagaggaagttcctccagagatccctgaaccagctttgggtataaactttgctagggatggcatgaatgagaaggattggttagcgctagttgctgtccacagcgattcctggttactagcagttgcattctactttgcagcccggtttgggtttgacaaagaggccagacggcggctcttcaacatgataaataacttgcccacgatatttgaagtagtgactggggttgcaaataaacaaaacaaggagaagggccccaatagtaccagcaaaagcaacaaaacaagttcaaaaatgacatcaagacccgagtctcattccaaggcgacaaaagtggcagtgccccctaaggatgacgatgatgagagcggtgaagaatatgaagaggaagagcgtgataacaccttatgtggatcatgtggaacaaatgacggcaaggacgaattctggatctgttgtgatagttgtgagcggtggtaccatgggaagtgtgtcaagatcactcctgcacgtgctgagcacatcaagcactacaaatgcccagattgcaacaacaagagggcaagagcctagcgtcaagccctggtgtgaccctggagtgaagtaagcgtcaaatcattgatgtctgcagatatatgcctacttgtctagcttgtagacttgcttttcatttcgcatgaacgctattgattcactcggttgccctctgcagctcatattgctcgggcttaattgtgtttaatgttttataagcggttgttgttgtagtaccaggcagtcttgcagacatgtgatagacgtttttggactcggcttaactgaccgttctacattgctagtctaaaaaaaaaaaaaaaaaaa

SEQ ID NO: 182 - protein, 256 aa, Zea mays
MDPGAGAHYSVRTAEEVFRDFRGRRAGMIKALTNDVEKFYQLCDPEKENLCLYGYPNETWEVTLPAEEVPPEIPEPALGINFARDGMNEKDWLALVAVHSDSWLLAVAFYFAARFGFDKEARRRLFNMINNLPTIFEVVTGVANKQNKEKGPNSTSKSNKTSSKMTSRPESHSKATKVAVPPKDDDDESGEEYEEEERDNTLCGSCGTNDGKDEFWICCDSCERWYHGKCVKITPARAEHIKHYKCPDCNNKRARA

SEQ ID NO: 183 - DNA, 1510 bp, Zea mays
gaactccataaaccctagcggacaaagccacttgctcacaccagaaccctctccgcaatctccccgcctcgctcccgcctccacccaatggcgtctctccctaacggtggcggcgccgccgcctctggctcatgcggcgcgcgccctgtggacaaggaggtggacttcgccaactacttctgcacgtacgcctacctttaccaccagaaggagatgctctgcgaccgcgtccgcatggacgcgtaccactccgccgtcttccgcaacgcgccccacttccagggcaaggtggtccttgacgtgggcaccgggagcggcatccttgctatctggagcgcgcaggccggggccaggaaggtgtacgccgtcgaggcgactaacatggcggagcacgcgcgcgagcttgctcgcgccaacggcgtcacggatatcgttgaggtgatacagggcaccgtggaagacgttgaccttccggagaaagttgatgtcattatatcagagtggatgggctactttcttttgagagagtccatgtttgattccgtcatttgcgcacgtgaccgctggttgaagccagatggtgtgatgtatcctagccatgctcggatgtggctagcacccataagaactggtttgggtgacaagaagagggaagattttgatattgctatggatgactggagcctgtttgttcaggacactcaaacttattatggtgtcaacatgaatgctttgacaaaggcatatcgtgcagaacatgaaaaatactatttgaagtcttcaatatggaacaatcttcatccaaaccaagttatcggtcaacctgcagctatcaaggaaattgattgcttgacagccactgtcgatgagatccgagaagtcagagcacaagtcacattgccaatcagaatggaagctagattatcagcactggctggatggtttgatgttcattttcgaggtagtgctcaaaaccctggggtggaggaagttgaattaactacagcgccagatgagcatggtggaactcattggggtcagcaggtattcttgctgactccacctctgagtgtgactaaaggagacaacgttaacgtttccttctcgatggttcgctcgaaggaaaaccatcggcttatggatatggagttcacatatgaattgcacgagttatctggcaggaagcacccagcagtcaaaaccaagatgtacttagagtagaacaagatggaaagacggaacctcacgacgccgttgctgaaacctttgctcagaagctgagcatgtagtgtgcttgttacacccatgatgggtacattgagaccatttatgttgtattggtaatatcttgtttgattgcccaattaacggggtgagctattgtttcatcacaacatcgatgtgttagcagataaccacattgccgttttaagcaaacattgggtgcggaattttgttgtctttgtgaagtccaaaaaaagcatcttcttctgatcaaaaggatagagtg

SEQ ID NO: 184 - protein, 377 aa, Zea mays
MASLPNGGGAAASGSCGARPVDKEVDFANYFCTYAYLYHQKEMLCDRVRMDAYHSAVFRNAPHFQGKVVLDVGTGSGILAIWSAQAGARKVYAVEATNMAEHARELARANGVTDIVEVIQGTVEDVDLPEKVDVIISEWMGYFLLRESMFDSVICARDRWLKPDGVMYPSHARMWLAPIRTGLGDKKREDFDIAMDDWSLFVQDTQTYYGVNMNALTKAYRAEHEKYYLKSSIWNNLHPNQVIGQPAAIKEIDCLTATVDEIREVRAQVTLPIRMEARLSALAGWFDVHFRGSAQNPGVEEVELTTAPDEHGGTHWGQQVFLLTPPLSVTKGDNVNVSFSMVRSKENHRLMDMEFTYELHELSGRKHPAVKTKMYLE

SEQ ID NO: 185 - DNA, 1263 bp, Zea mays
  misc_feature 1257: n = A,T,C or G
gcaccaggggagctctgccgagacacgcacgctgctggagataggcatccagacacggcaccaccagtccaccaccaccaccaccaccaccgtgacgtgagtgcccgagcgcgcggccgccatcaggctcccccgtcgtcctcgccgggcggctaggtcagagccgggagaggcgggggccggcggcgctaggctaggctaggctaggcagcggcgtacgtgcgtggccgccgcgcgatcggcatgggcgacggcgaggcggcggtgccgagcaggttccgcacggtctgcgtcttctgcggcagcaacgccggccgccgcaaggtgtacgccgacgccgccctcgagctcggccacgagctggtgcggaggggcatcaacctcgtctatggcggcggcagcatcggtctgatgggcgtgattgctcggacggttcgtcacggcggctgccatgtcctcggggtgattcctaaagcgctcatgcctattgagatatcaggtgaaagcgtgggagaggtgagggtcgtggacgacatgcaccagaggaaagccgagatggctcgtcagtcccaagccttcatcgctctcccaggggggtacgggacgatggaggagctgctggagatgatcacctggtgccagctcgggatccatgacaaaccagttgggttgctgaacgtggacggctactacgaccccctgctcgccctgttcgagaaaggcgccgccgagggtttcatcagcaccgactgcagccagatattcgtctcggcgccaaccgcgagcgagctgctcacaaagatggagcaatacacgcgggtgcaccaggaggtagccccagcgacgagctgggagatctcggagctcggctacggcagaggaggagacgccggcgccgccacgccgccagcagcagcagcaggaggagcagaagagggaaaaggcggctcgtagcacccacatccatctcctgaagcgttaccttcctccacctactgcttgctgatgtgatgacgcgtctgttacggtttcctggcaaatttgtttcgtcaaagtcgacctctccaaagtccaaaacccggttgaaccaggtgccgggtcgggacgtactggggagacgacgatgatatctctgtgttgggtgcttggattgtgtaagcttgctgctgctggtactattcttgttttctttactttttccccggtgtgtggtgcttgtggaaatggaatctgtgctggtgcattgcagtgcaaaanaaaaaa

SEQ ID NO: 186 - protein, 212 aa, Zea mays
MGDGEAAVPSRFRTVCVFCGSNAGRRKVYADAALELGHELVRRGINLVYGGGSIGLMGVIARTVRHGGCHVLGVIPKALMPIEISGESVGEVRVVDDMHQRKAEMARQSQAFIALPGGYGTMEELLEMITWCQLGIHDKPVGLLNVDGYYDPLLALFEKGAAEGFISTDCSQIFVSAPTASELLTKMEQYTRVHQEVAPATSWEISELGYGR

SEQ ID NO: 187 - DNA, 1942 bp, Zea mays
atcggttcctgctctgtgctatactgctatcccctcccccaagccgccaccaccaccagcagcggaaccccccgccctcgttcctcccccgccggcgagagatcgacgagatggtgctgtcacacggcgtcggtggctccgatgagtccgtccactcgacgttcgcgtcccgctacgtccgcacctcccttcctaggtaccggatgccggagcagtcgatccccaaggaggcggcgtaccagatcatcaacgacgagctgatgctggacgggaacccgcggctgaacctggcgtccttcgtcaccacgtggatggagcccgagtgcgacaagctcatccaggcctccgtcaacaagaactacgtcgacatggacgagtaccccgtcaccaccgagctgcagaaccggtgcgtgaacatgatcgcgcatctcttcaatgctcctctcggggacgctgaaacggctgttggagtgggcaccgtcggctcgtccgaggccatcatgctggctgggctggcgttcaagaggcgttggcagaacaagatgaaggcggccggcaagccctgcgacaagccaaacattgtcaccggcgccaacgtccaagtttgctgggagaagttcgcgcgctacttcgaggtcgagctgaaggaagtgaagctgagcgacggctactacgtcatggacccgcagaaggcagtggacatggtggacgagaacaccatctgtgtcgcggccatcctcggttccacgctgaacggcgagttcgaggacgtgaagctgctcaacgacctgctcaccaagaagaacgcggagacaggctgggacacgccgatccacgtggacgcggcgagcggcgggttcatcgcgccgttcctgtacccggaactggagtgggacttccgactgccgctcgtgaagagcatcaacgtcagtggacacaagtatggtctggtctacgccggcatcgggtggtgcatctggaggaccaaggcggacctgccggaggagctcatcttccacatcaactacctcggcgccgaccagcccaccttcaccctcaacttctccaaaggttccagccaggttattgcacagtactaccagctgatccgccttggctttgaaggttacaagaacatcatggagaactgccaggagaacgcgacggttctgaagcaaggtctggagaagacggggaagttcaacatcgtgtccaaggacaacggcgtgccgctggtggccttctccctcaaggacagcagccggcacagcgagttcgagatctccgacttcctgcgccgcttcgggtggatcgtgccggcctacacgatgccccccgacgcgcagcacgtgaccgtgctccgcgtggtcatccgcgaggacttcagccgcaccctcgcggagcgcctggtgctcgacatcgagaaggttctgcacgagctggacgcgctgcccgcccgtgtccccagcggcgacctagccgcgctcgccgcggccgagtccagcgagagggagatggagaagcagcgccaggtgatctcgctctggaagagggccgtcctcgccaagaagaagaccaacggcgtctgctaagcagccgagccgacgcatttctggccgtattggcatggggtgaaatttgtctgagtacgcgtttgcagtttttacccgggtgaagattgttatgtgtcgaggttgagttttagaggacggaattgctccggctcggtgtatgtagcgagtgttttacgtgctcaacaactctcagacttccctcccctcttgcatgtaagctgtaagtcgatgcaaataatgttgcgtgtcgagcgacgattagtaatagtacctgatggggtacttgtattagtattgatatttgaacgttacactatacattatgtgacatactattaatattgctcgacaaagtaatatatcggctc

SEQ ID NO: 188 - protein, 493 aa, Zea mays
MVLSHGVGGSDESVHSTFASRYVRTSLPRYRMPEQSIPKEAAYQIINDELMLDGNPRLNLASFVTTWMEPECDKLIQASVNKNYVDMDEYPVTTELQNRCVNMIAHLFNAPLGDAETAVGVGTVGSSEAIMLAGLAFKRRWQNKMKAAGKPCDKPNIVTGANVQVCWEKFARYFEVELKEVKLSDGYYVMDPQKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRTKADLPEELIFHINYLGADQPTFTLNFSKGSSQVIAQYYQLIRLGFEGYKNIMENCQENATVLKQGLEKTGKFNIVSKDNGVPLVAFSLKDSSRHSEFEISDFLRRFGWIVPAYTMPPDAQHVTVLRVVIREDFSRTLAERLVLDIEKVLHELDALPARVPSGDLAALAAAESSEREMEKQRQVISLWKRAVLAKKKTNGVC

SEQ ID NO: 189 - DNA, 3081 bp, Zea mays
  misc_feature 3066, 3067, 3068: n = A,T,C or G
cgacgcgcagtcgcccattccgcatctcgccctcccgtcccgtccgtccgttctccgattggccgccgcccgcctcgccctcctcgtcaacaaaagcccaccgcaagcgagcgagcgagccaccccgcccgatagccgccgccgccgtcccgcccccacccgactcctcctgaccgccggcgtggggtgcccgggctccacctccggcgacgacaccctccccgccgcgcgcgcccccaccgcctgctccgtttgcgggggtagccggggctccggcctcggcggctttcaaagccccctccctcacaacaggatccaaaatcccgtcctagacttcttctacctccccttccagaacttcctcttttggcatcccggacggtcgatctcgacccccttcgatttcgattcatctcttcttatcgattgatctttcttctagcttatttcgtatactgtcattttgattccttccttcttcccgccgccggtagctaatcccaaatcccaatcgaatcgactcccccctgttcgtcggattctcttcctccgtccgcacccagctaacgccaccgaaaacagaaaatttacccgccgcccaaaaaaaaacagaaaggctaacctccttttttctctctctatctttctctccatctgtggacttctccggttttgtttgacgagatgcctgcgctcgccgtcgacgccgcgacacccgtggcgcacgccttcgcgtcctgcgacgcggcgcgcttccccgccccgcccgtggtgggccccgccgccgcggccgaggccgccccctggtcggccgacctctccgcggcgctctacaacgtggacggctggggcgcgccctacttcttcgtcaacgacgacggcgacgtggccgtgcgcccgcacggcgccgcgactctcccgggccaggagatcgacctggccaaggtcgtggccaaggccgcgggcccgcgcgccggaggcgggctcggcctgccgctgccgctgctcgtgcgcttccccgacgtcctgcgccaccgcgtcgagacgctcaacgccgccttcggctacgccgtccgctccaccggctacggctcaaggtaccagggcgtgtacccggtcaagtgcaaccaggacaggtacgtcgtcgaggacattgtggagttcggcgcgccctttgggttcggcctcgaggccggctccaagcccgagctgctgctcgccatgagctgcctcgccgcgcgcggcggcctggacgccctgctcatctgcaacgggtacaaggacgacggctacgtctcgctcgcgctcatggcgcgctccatgggcctcaacaccgtcatcgtgctcgagcaggaggaggagctcgacattgtcgtcgaggccagccgccgcctcggcgtgcgccccgtcgtcggcatgcgcgccaagctgcgcaccaagcacgccggccacttcggctccacgtccggggagaagggcaagttcggcctcagcgccgcgcagatactgtccgtggtcaccaagctcaaggccatcggtatgctcgactgcctccagctgctgcacttccacatcggctcccagatcccgaccaccgccctgctctccgacggcgtcggcgaggccgcgcagatctactgcgagctcgcccgcctcggcgcggacatgcgcgtcatcgacgtcggcggcggcctcggcattgactacgacgggacccactcggcgcagaccgacatgtcggtggcgtacagcctggaggagtacgcgggcgccgtggtggccgccgtgggccgcgtgtgtgaccgcaagggggtgcagcaccccatcatctgcagcgagagcggccgcgcgctggtgtcgcaccactcggtcctggtgttcgaggccttctcggctacggcgccgggacgcctggacgcggccacggcctacctcctcgacgagctcacggacgactgccgcgccgactaccgcaacgtgatggccgccgccgtgcgcggcgactacgacacgtgcggcctgtacgccgaccagctgaagcggcggtccgcggagcagttcaaggagggggtccttggcctggagcacctcgccgcggtggacgccttctgcgagctcgtcgcccgcggcatgggcgcgcccgagccgccgcgcacctaccacatcaacctgtccgtgttcacctccctgccggacatgtgggccatcgggcagcagttccccatcatcccgatccagcggctgcaggagcggcccgccgtcgacggcgtgctctcggacctcacctgcgacagcgacggcaaggtgagcgagttcatcggcgggaggcacagcctgccgctgcacgagctgcccacccacgccactcgcggctactacctgggcatgttcctcgggggcgcctaccaggaggccctcggcgggctgcacaaccttttcggcgggcccagcgtggtgcgcgtgtcccagtgcgacgggccccactgctttgccgtgacgcgcgccgccgcgggcccgtcctgcgccgacgtgctccgcgcgatgcagcacgagcccgaggtgatgtacgaggtgctgaagcagaggaccgacggcgccacggccgccgccctcgcccgggccttcggcgcaatgccgtacctggtgttcgaccccgaggccgccgtgatgtccggcggcgagagcagcgactcggagcggtcggccgccggcgccgccgaggaggaagacgatgaggagtgggagttcatgcgcgggctcaccgtctgatgacgtgcccgcccgcccgccccgggtgaaacaaggcgagtccgtcgccaggaagttgtcagtggccggccggcgttggtttacataataacccccaccgcccggtgttgtatcgtgtcgtggtcgtagtcgtcgggtgtctcgtcgtcgccggagttgtttggcgccacctttttattccgaacgcgtcagtgtccactgttcgcctttccttttttttctctctctttcatgggaataatctgaaggaaactaatagcaagtttctctttaactggaaaaaaatttcgttttttnnngaattcattctgt

SEQ ID NO: 190 - protein, 694 aa, Zea mays
MPALAVDAATPVAHAFASCDAARFPAPPVVGPAAAAEAAPWSADLSAALYNVDGWGAPYFFVNDDGDVAVRPHGAATLPGQEIDLAKVVAKAAGPRAGGGLGLPLPLLVRFPDVLRHRVETLNAAFGYAVRSTGYGSRYQGVYPVKCNQDRYVVEDIVEFGAPFGFGLEAGSKPELLLAMSCLAARGGLDALLICNGYKDDGYVSLALMARSMGLNTVIVLEQEEELDIVVEASRRLGVRPVVGMRAKLRTKHAGHFGSTSGEKGKFGLSAAQILSVVTKLKAIGMLDCLQLLHFHIGSQIPTTALLSDGVGEAAQIYCELARLGADMRVIDVGGGLGIDYDGTHSAQTDMSVAYSLEEYAGAVVAAVGRVCDRKGVQHPIICSESGRALVSHHSVLVFEAFSATAPGRLDAATAYLLDELTDDCRADYRNVMAAAVRGDYDTCGLYADQLKRRSAEQFKEGVLGLEHLAAVDAFCELVARGMGAPEPPRTYHINLSVFTSLPDMWAIGQQFPIIPIQRLQERPAVDGVLSDLTCDSDGKVSEFIGGRHSLPLHELPTHATRGYYLGMFLGGAYQEALGGLHNLFGGPSVVRVSQCDGPHCFAVTRAAAGPSCADVLRAMQHEPEVMYEVLKQRTDGATAAALARAFGAMPYLVFDPEAAVMSGGESSDSERSAAGAAEEEDDEEWEFMRGLTV

SEQ ID NO: 191 - DNA, 2197 bp, Zea mays
cacaccacagcactaaagtctattcatctctggctccccaaattcagctggagagcactttttcccatcatggataagaactacggtgaactctacaacatcctcggatggggtgaggagtacttcgcggtgaacacggaggggcacctcagcgtgaagcctttcggccgctggacggagcccgggcaggagatcgacgtgcactcggtcatcgtggaagctctagcgacccaacccaacgacagcaccagcaaatctcagttccccatgatccttcgcttccccgacgtgctcaagaaccgtatcgagacgctccataacgcattcaacagcgccatggagtccaccgggtacacgtccaggtaccaaggcgtgttcccgatcaaggtgaaccagaacaagcacgtcgtgcaggacatggttaggttcggccagcaatggaactatgggctcgaggctggctccaagccagaactgctcatcgccatgagctgcctccccgtcaccgaagccgagcccaagccgtacttgatctgcaacggctacaaggacgcggactacatcgcgctcgcgctctcggcgcgggccatgggcctgaaccccatcatcgtgctcgagatggaggaggagcttgccatcgtcctcgaccagtacaggaagctgcagcagaagctgccagacgacgatgccgtgcgcaagaagttcgagccgatcatcggcatccgcgccaagcttctcaccaagctaccaggccacttcggttcgacggccggcaagcacggcaagttcgggatgctcgccgaccagatctacgaggtggccgagacgctcggcaaggagggcaagttgcactggctccagctgctgcacttccacatcggctccatgatcccgacgacggggaaagtgtacgacgcggtgagcgaggcagctggcatctactgcaacctggtgaacgagcacggcgccaagtggttggccacgctggactgcggcggcgggctcggggtcgactacgacgggacccgttcaggcgactccgacatgtcggtggcgtacgggatacaggagtacgcctccgccgtcgtgcaggcggtgcggctcaagtgcgactacaacggcgtcgcgcacccggtcgtgtgcaccgagagcgggcgcgccatggcgtcgcaccactccatgatcatcctcgagacgctctcggcgatcccggagccgcaggacgaggacacctccgagcagctgttgaacaggatccaggacctatcttacaagcagccgagagctccggttggcggcgccacggcggccgtttactctcacgccgcagacctcaagaagcacggcatcgagatgtacaagcttggcaagaagctcggcaagagggtcgtcgccgatgccaacaccgtctataactaccacatgaacctctccgtcttctcgctggtgcctgacttctggggcatcgggcagctcttcccgatgatgccggtgagccgcctcaacgaggagccgactctcaagggcacgctggtggacatcacctgcgacagtgacgggaagatcgagaacttcatcagccgcgaaaacacattgccgctgcacctgttcgagccgagcctcggtggctactatgtggccgtactcgtctccggggcgtaccaggaggccattgctggcaagcacaacctgttcagtggcccaacactcgttcgtgtcaatagtagcactacaaaagatggcggcttcgagattgaacgcgttgacctgggcccagctgcggatgagatcatcggcagcatgaggtacagcgtcgaggaagacattatcaccgtcatcgagaagaaagccaaggggacagaagaagaagaacgtgtgtgggcgtgggagatggtggagccactcatgaccaaagcgctcaccaccatgccctacctcaacgaatacaaggttcctgaacctgaacctgaacctgaacccatcccttgaacttctgcactgcagagtctccggatttggctgcgactgcgatcatatatacaataagaactgcctggttgatgatggataagcagataacgaaagcagcctatgtatgtgtgtttcccttttttgagtttaccctgctcgcttgcatcttgttattgtacgtgttatccaataaataaaacaagcttcactggtgtgtttaattgct

SEQ ID NO: 192 - protein, 639 aa, Zea mays
MDKNYGELYNILGWGEEYFAVNTEGHLSVKPFGRWTEPGQEIDVHSVIVEALATQPNDSTSKSQFPMILRFPDVLKNRIETLHNAFNSAMESTGYTSRYQGVFPIKVNQNKHVVQDMVRFGQQWNYGLEAGSKPELLIAMSCLPVTEAEPKPYLICNGYKDADYIALALSARAMGLNPIIVLEMEEELAIVLDQYRKLQQKLPDDDAVRKKFEPIIGIRAKLLTKLPGHFGSTAGKHGKFGMLADQIYEVAETLGKEGKLHWLQLLHFHIGSMIPTTGKVYDAVSEAAGIYCNLVNEHGAKWLATLDCGGGLGVDYDGTRSGDSDMSVAYGIQEYASAVVQAVRLKCDYNGVAHPVVCTESGRAMASHHSMIILETLSAIPEPQDEDTSEQLLNRIQDLSYKQPRAPVGGATAAVYSHAADLKKHGIEMYKLGKKLGKRVVADANTVYNYHMNLSVFSLVPDFWGIGQLFPMMPVSRLNEEPTLKGTLVDITCDSDGKIENFISRENTLPLHLFEPSLGGYYVAVLVSGAYQEAIAGKHNLFSGPTLVRVNSSTTKDGGFEIERVDLGPAADEIIGSMRYSVEEDIITVIEKKAKGTEEEERVWAWEMVEPLMTKALTTMPYLNEYKVPEPEPEPEPIP

SEQ ID NO: 193 - DNA, 1747 bp, Zea mays
ccaagaccacatcggcacatcgacgtgagctcgtgcgtgagtgccctggtcgacgaccgctcgcgcgccatggactcaacgacgacggcgccgctgctgcagccgtccgccgcctcgagcaaggaggggccggggccggcgccggctcagcacggtgagggcagccgggagctggaggcgatcctggccgacgcgtccaagccgtgggcttggcgggcctgggaaggcgcccgcctggagctgccgctgctgctgcgggtggcgctgccggcggtggccgtctacatgatcaacttcgtcatgtccatgtccacgcagatcttctgcggccagctcggcaacctcgagctcgccgcctcctcgctcggcaacaccggcatccagcccttggcctacggcctcatgctgggcatgggcagcgcggtggagacgctgtgcgggcaggcgtacggcgcgcacaagcaccgcatgctgggggtgtacctgcagcgctcgacggtgctgctcatggccaccgccgtgccgctgaccgtcgtctacgccttctcggagcgcatcctggtcctcctcggcgagtcggagcgcatctccagggccgccgccgtcttcgtctacgggctcatcccgcagatcttcgcgtacgcggccaacttccccatccagaagttcctgcaggcgcagagcatcgtggcgcccagcgcttacatctccgtggccacgctggcgctgcacctggggctcagctgggtcgccgtctacaggctgggcctgggcctgctggggggctcgctcgtgctcagcttcagctggtgggtcatcgtcgcggcccagttcgggtacatcgtcaccagcgcccggtgcagggacacctggacgggattcaccacgcaggccttctcgggcctcggcaccttcttcaagctctcggcagcgtccgccgtcatgctgtgcttggagacttggtacttccagatcatcgtgctcatcgccggcctgctcaagaacccggagctctccctcgactccctctccatatgcatgaacgtgaacgcatgggtgttcatgatctccgtcgggttcaacgccgcggcgagcgtgcgggtcgggaacgagctcggcgcaggcaacccgagggcggcggcgttctcggtgttcatggtgacgtcgctgtcgttcatcgcggcgacggtgtgtgccgtcgtcgtgctgtgcctccgcgaccagctgagctacttcttcactggcggcgaggccgtggcgcgcgccgtgtccgacctctgcccgctcctcgccgccacgctcgtcctcaacggcatacagccagtcctctccggcgtcgccgtgggctgcgggtggcaggcgtttgtggcgtacgtgaacgtgggttgctactacgtcgtcggcgtgccgctcggcgtcttcctcggcttctacctcgacctcggcgccaagggcgtttggagcggcatggtcatcgggggaaccttgacgcagacgctcatcctgctctgggtcaccgtcagaaccgactggaacaaggaggtggagaacgccaaggcgaggctggacaagtgggacgacaagaagcagcccctcctagtcgaagattgaaggaagaatctagtagatcacgcagtgtagcgcgtgctggtggattttttgtgtgtcgtgtgtgtgttttggagtggattgaatggaccatttggcatttgggttttagagagcatgcatgcactcctaaaaaaaa

SEQ ID NO: 194 - protein, 1747 aa, Zea mays
CCAAGACCACATCGGCACATCGACGTGAGCTCGTGCGTGAGTGCCCTGGTCGACGACCGCTCGCGCGCCATGGACTCAACGACGACGGCGCCGCTGCTGCAGCCGTCCGCCGCCTCGAGCAAGGAGGGGCCGGGGCCGGCGCCGGCTCAGCACGGTGAGGGCAGCCGGGAGCTGGAGGCGATCCTGGCCGACGCGTCCAAGCCGTGGGCTTGGCGGGCCTGGGAAGGCGCCCGCCTGGAGCTGCCGCTGCTGCTGCGGGTGGCGCTGCCGGCGGTGGCCGTCTACATGATCAACTTCGTCATGTCCATGTCCACGCAGATCTTCTGCGGCCAGCTCGGCAACCTCGAGCTCGCCGCCTCCTCGCTCGGCAACACCGGCATCCAGCCCTTGGCCTACGGCCTCATGCTGGGCATGGGCAGCGCGGTGGAGACGCTGTGCGGGCAGGCGTACGGCGCGCACAAGCACCGCATGCTGGGGGTGTACCTGCAGCGCTCGACGGTGCTGCTCATGGCCACCGCCGTGCCGCTGACCGTCGTCTACGCCTTCTCGGAGCGCATCCTGGTCCTCCTCGGCGAGTCGGAGCGCATCTCCAGGGCCGCCGCCGTCTTCGTCTACGGGCTCATCCCGCAGATCTTCGCGTACGCGGCCAACTTCCCCATCCAGAAGTTCCTGCAGGCGCAGAGCATCGTGGCGCCCAGCGCTTACATCTCCGTGGCCACGCTGGCGCTGCACCTGGGGCTCAGCTGGGTCGCCGTCTACAGGCTGGGCCTGGGCCTGCTGGGGGGCTCGCTCGTGCTCAGCTTCAGCTGGTGGGTCATCGTCGCGGCCCAGTTCGGGTACATCGTCACCAGCGCCCGGTGCAGGGACACCTGGACGGGATTCACCACGCAGGCCTTCTCGGGCCTCGGCACCTTCTTCAAGCTCTCGGCAGCGTCCGCCGTCATGCTGTGCTTGGAGACTTGGTACTTCCAGATCATCGTGCTCATCGCCGGCCTGCTCAAGAACCCGGAGCTCTCCCTCGACTCCCTCTCCATATGCATGAACGTGAACGCATGGGTGTTCATGATCTCCGTCGGGTTCAACGCCGCGGCGAGCGTGCGGGTCGGGAACGAGCTCGGCGCAGGCAACCCGAGGGCGGCGGCGTTCTCGGTGTTCATGGTGACGTCGCTGTCGTTCATCGCGGCGACGGTGTGTGCCGTCGTCGTGCTGTGCCTCCGCGACCAGCTGAGCTACTTCTTCACTGGCGGCGAGGCCGTGGCGCGCGCCGTGTCCGACCTCTGCCCGCTCCTCGCCGCCACGCTCGTCCTCAACGGCATACAGCCAGTCCTCTCCGGCGTCGCCGTGGGCTGCGGGTGGCAGGCGTTTGTGGCGTACGTGAACGTGGGTTGCTACTACGTCGTCGGCGTGCCGCTCGGCGTCTTCCTCGGCTTCTACCTCGACCTCGGCGCCAAGGGCGTTTGGAGCGGCATGGTCATCGGGGGAACCTTGACGCAGACGCTCATCCTGCTCTGGGTCACCGTCAGAACCGACTGGAACAAGGAGGTGGAGAACGCCAAGGCGAGGCTGGACAAGTGGGACGACAAGAAGCAGCCCCTCCTAGTCGAAGATTGAAGGAAGAATCTAGTAGATCACGCAGTGTAGCGCGTGCTGGTGGATTTTTTGTGTGTCGTGTGTGTGTTTTGGAGTGGATTGAATGGACCATTTGGCATTTGGGTTTTAGAGAGCATGCATGCACTCCTAAAAAAAA

SEQ ID NO: 195 - DNA, 2198 bp, Zea mays
caccgcacacacacgcacaggcagcagcacagcgatctgccttctgctgtgccccgcccccatccagcccagagcagcagcgcgcggtgccggccggcaaccgcagctggtcggtcatcaggtctctgggcctccacctcctccttccccctctcaaccctccccgtgtcgcctcctcccgaatcctcacacgtagccccgcgcgccacctcgctgccggccgccggcacacagatatagagagagagagagagagagagagagactgagagagagagagggaggggaagcgaagagaccagaacaagagcgaagatggtcggactcctccccgagaccaatgccgcggcggagacggacgtcctcctcgacgcctgggacttcaagggccggccggccccgcgcgccaccaccggccgctggggcgccgccgccatgatcctagtggcggagctgaacgagcggctgacgacgctgggcatcgccgtgaacctggtgacgtacctgacgggcaccatgcacctgggcaacgccgagtccgccaacgtcgtcaccaacttcatgggcacctccttcatgctctgcctcctcggcggcttcgtcgccgactccttcctcggccgctacctcaccatcgccatcttcaccgccgtccaggcctcgctgctggccgtcaccgtgctggtgtacgtccaggacaacctgggcaggcgctggggctacggcgcctgcgcctgcgccatcgccgcgggcctcctcgtcttcctggccggcacacgcaggtaccgcttcaagaagctggccggcagccccctcacgcagatcgccgccgtcgtcgtcgccgcctggcgcaagcgccgcctccctctccccgccgaccccgccatgctctacgacgtcgacgtcggcaaggccgccgccgtcgaggatgggtcctccagcaagaagagcaagcgcaaggagcgcctcccccacaccgaccagttccgcttcctggaccacgcggcgatcaacgaggatccggcggcgggggcgagcagcagcagcaagtggcggctggcgacgctgacggacgtggaggaggtgaagacggtggcgcggatgctgccgatctgggcgaccacgatcatgttctggacggtgtacgcgcagatgaccaccttctcggtgtcgcaggccaccaccatggaccgccgcgtcgggggctcgttccagatccccgcgggctccctcaccgtcttcttcgtcggctccatcctgctcaccgtgcccgtctacgaccgcctggtggtgcccgtcgcgcgccgcgtcagcggcaacccgcacggcctcaccccgctgcagcggatcgccgtcggcctcgcgctctccgtcgtcgccatggcgggcgccgcgctcacggaggtccgccgcctccgcgtcgcgcgcgattcctccgagtccgcctccggaggcgtcgtgcccatgtccgtgttctggctcatcccgcagttcttcctcgtgggggcgggcgaggcgttcacgtacatcggccagctcgacttcttcctgcgcgagtgccccaaggggatgaagaccatgagcacggggctgttcctcagcaccctgtcgctgggattcttcgtcagctccgcgctcgtcgccgccgtgcacagggtcacgggcgaccgccacccctggatcgccaacgacctcaacaagggccgcctcgacaacttctactggctgctcgccgccgtctgcctcgccaacctactagtctacctcgtcgccgcccgctggtacaagtacaaggcgggccgccccggcgccgacggcagcgtcaacggcgtcgagatggccgacgagcccacgctccactgatccatccatgttcgatcgatcgacgaggcacgcgacggacgaccctaaattgaaccctatacaccgagcttaattatatatccgtccgatcgtcgtcggtcagattcattgctagctccgcgtgttgtaccatcgtgtcagtcagtgtatacgagtgtgtatcttttgtatccaagtacagcacgcgcgcgtgcgtaagcgtgtagttataaaaattaataacatgtttcttagaggagtgaggggggaattgtaaaaccgcttgtcaattgggctaagatcgttcgggacactgagcaaactcagaatgagttaagtttttcattttcataaaa

SEQ ID NO: 196 - protein, 515 aa, Zea mays
MVGLLPETNAAAETDVLLDAWDFKGRPAPRATTGRWGAAAMILVAELNERLTTLGIAVNLVTYLTGTMHLGNAESANVVTNFMGTSFMLCLLGGFVADSFLGRYLTIAIFTAVQASLLAVTVLVYVQDNLGRRWGYGACACAIAAGLLVFLAGTRRYRFKKLAGSPLTQIAAVVVAAWRKRRLPLPADPAMLYDVDVGKAAAVEDGSSSKKSKRKERLPHTDQFRFLDHAAINEDPAAGASSSSKWRLATLTDVEEVKTVARMLPIWATTIMFWTVYAQMTTFSVSQATTMDRRVGGSFQIPAGSLTVFFVGSILLTVPVYDRLVVPVARRVSGNPHGLTPLQRIAVGLALSVVAMAGAALTEVRRLRVARDSSESASGGVVPMSVFWLIPQFFLVGAGEAFTYIGQLDFFLRECPKGMKTMSTGLFLSTLSLGFFVSSALVAAVHRVTGDRHPWIANDLNKGRLDNFYWLLAAVCLANLLVYLVAARWYKYKAGRPGADGSVNGVEMADEPTLH

SEQ ID NO: 197 - DNA, 2348 bp, Zea mays
tcgcctcatcgtcatctacctcgctcgcaccacacgcgaaaccgaacaaactactcgtacaaactacaaagagaagagacaagtgtatttattttattaatcattagtactattgattagtattattgaaacagaggcattgccgatactcacgccggcgaccgatgggatcggagggtgagatcaccggcccgctcctcgcgtcgggcgccggcgcgccggcgccggaggcggtgcccccgtggcgggagcaggtgacggctcgggggctggcggtcagcgccgtcctgggggtgctcttctgcctcattacgcacaagctcaacctcaccgtcgggatcatcccctcgctcaacgtcgccgcggggctgctcggctacttcctggtccgcacctggacggcggcgctcgagaggttcggcgtcgtctccaagcccttcaccaagcaggagaacaccgtcattcagacatgcgtcgtcgcctgctacggcctcgccttcagcggggggtttggaagctatatgcttgcaatggaccagagaacctatgaacttatcgggccagattatcctggcaacagggccgtggatgtcaagactccttcactgggctggatgattggattcatgtttgttgttagcttccttgggctgtttagtcttgttgcactacgcaaggttatggtaattgattacaagctgacttatcccagtgggacagccacggctatgttgataaatagtttccacacaactactggagctgagcttgcagacaagcaagtcaggtgtcttgggaagtacttgagcattagttttatatggaactgctttaaatggttcttcagcggtgttggagattcttgtggtttcgataatttcccttctttgggacttgcagcatttaagaatacgttttattttgatttcagcccaacctatattggatgtggtcttatttgtccgcatattgttaattgttctacacttcttggtgccataatatcgtggggtattctttggccatatatctccacaaaagctggggactggtatccagctgaccttggaagcaatgacttcaaaggactctatggatacaaggtttttatatctgtatctgtgatacttggggatggtctttataacctcatcaagatcatttatgctactatcaaggaaataatgaatgcacgggctaagcaaggaagactgccactagcccaagttcaggatggcgatgaaggttcaaatttatcagctgaggaaaagcatctgaatgagacattcataaaggacagtatccctccctggttggcaggatctggttacattggccttgcagcaatatcgattgcaaccgtcccaatgatctttccgcagatcaagtggtaccttgtcctctcggcatacgttgttgctcccctcctcgctttctgcaactcatatggcactggactaacggactggaatcttgcgtctacatatggaaagatcggcctcttcatttttgcatcatgggttggtcagaatggcggtgtgattgctggcttagcagcctgcggtgttatgatgtccatcgtgtccactgcagccgatctcatgcaggacttcaagaccggttacctcacactctcttcccctaggtccatgttcgtgtcgcagttgatcgggaccgcccttggttgtgtcattgctccactcaccttttggctctactggtcggctttcgatattggtaaccctgacggcgcattcaaagctccatatgctgtaatcttccgtgagatgtcaattcttggcgtggaagggttttctgcactgcctcagcactgcctagcgatctgctcgtttttcttcattgcatctctagtgatcaacctcctcagggacgtcaccccaaagaatgtctccagattcatcccaatcccgatggctatggccattcccttctacatcggtgcgtacttcgccatcgacatgtttgttgggacagttatccttttcgtctgggagagggtgaaccgcaaggagtgtgatgacttcgcaggtgcggttgcctctggcttgatctgtggtgatgggatctggactgttccttctgcgatactgtcaatccttaggattgacccgccaatttgcatgtacttcaagccatcccttagcagctaaagttgggacaagtgttatccattttctgtatatcaaaataggacctaattgtgtatatctttaatttactacatgtaaactgttctaggaagaaaagctgtagcctaatgcaatctgttgattcttatttgcgtatgataatccagcattcgtttatccaaaaaaaaaaaaaaaaaa

SEQ ID NO: 198 - protein, 668 aa, Zea mays
MGSEGEITGPLLASGAGAPAPEAVPPWREQVTARGLAVSAVLGVLFCLITHKLNLTVGIIPSLNVAAGLLGYFLVRTWTAALERFGVVSKPFTKQENTVIQTCVVACYGLAFSGGFGSYMLAMDQRTYELIGPDYPGNRAVDVKTPSLGWMIGFMFVVSFLGLFSLVALRKVMVIDYKLTYPSGTATAMLINSFHTTTGAELADKQVRCLGKYLSISFIWNCFKWFFSGVGDSCGFDNFPSLGLAAFKNTFYFDFSPTYIGCGLICPHIVNCSTLLGAIISWGILWPYISTKAGDWYPADLGSNDFKGLYGYKVFISVSVILGDGLYNLIKIIYATIKEIMNARAKQGRLPLAQVQDGDEGSNLSAEEKHLNETFIKDSIPPWLAGSGYIGLAAISIATVPMIFPQIKWYLVLSAYVVAPLLAFCNSYGTGLTDWNLASTYGKIGLFIFASWVGQNGGVIAGLAACGVMMSIVSTAADLMQDFKTGYLTLSSPRSMFVSQLIGTALGCVIAPLTFWLYWSAFDIGNPDGAFKAPYAVIFREMSILGVEGFSALPQHCLAICSFFFIASLVINLLRDVTPKNVSRFIPIPMAMAIPFYIGAYFAIDMFVGTVILFVWERVNRKECDDFAGAVASGLICGDGIWTVPSAILSILRIDPPICMYFKPSLSS

SEQ ID NO: 199 - DNA, 2073 bp, Zea mays
atccgcgccacaccctcccaatcccctccccctcgcgtatccacacttttcacacgcgacgccggagagacagagcgcgcgcgcgcccgaaagatgtcgacgtgcgcggcggacctggcgccgctgctcggcccggcggcggcgaacgccacggactacctgtgcgggcagttcgcggacacggcctccgcggtggacgccacgtacctgctcttctcggcctacctcgtgttcgccatgcagctcggcttcgccatgctgtgcgccggctccgtccgcgccaagaacaccatgaacatcatgctcaccaacgtgctcgacgccgccgcgggggcgctcttctactacctcttcggcttcgccttcgccttcggcacgccctccaacggcttcatcggcaagcagttcttcgggctcaagcacctgcccaggaccggcttcgactacgacttcttcctctaccagtgggccttcgccatcgccgccgcgggcatcacgtcgggctccatcgccgagcggacccagttcgtcgcctacctcatctactccgcgttcctgacggggttcgtctaccccgtggtgtcgcactggttctggtccgccgacggctgggccggcgccagccgcacgtccggcccgctgctcttcgggtccggcgtcatcgacttcgccggctccggcgtcgtccacatggtcggcggcatcgcggggctgtggggcgcgctcatcgagggcccccgcatcgggcgcttcgaccacgccggccgctccgtggcgctcaagggccacagcgcgtcgctcgtggtgctcggcaccttcctgctgtggttcggctggtacgggttcaaccccgggtccttcaccaccatcctcaagtcgtacggccccgccgggaccgtccacgggcagtggtcggccgtgggccgcaccgccgtcaccaccaccctcgccggcagcgtcgccgcgctcaccacgctgttcgggaagcggctccagacgggccactggaacgtggtggacgtctgcaacggcctcctcggcgggttcgcggccatcacggccgggtgcagcgtggtggagccgtgggcggccgtcatctgcgggttcgtgtccgcgtgggtgctcatcggcgccaacgccctcgcggcgcgcttcaggttcgacgacccgctggaggcggcgcagctgcacggcgggtgtggcgcctggggcgtcctcttcacggggctcttcgcgaggcgaaagtacgtggaggagatctacggcgccgggaggccctacgggctgttcatgggcggcggcgggaagctcctcgccgcgcagatcatccagatcctggtgatcgccgggtgggtgagctgcaccatgggcccgctcttctacgcgctcaagaagctgggcctgctgcgcatctcggccgacgacgagatgtccggcatggacctgacccggcacggcggcttcgcctacgtctaccacgacgaggaccctggcgacaaggccggggttggtgggttcatgctcaagtccgcgcagaaccgtgtcgagccggcggcggcggtggcggcggcgaccagcagccaggtgtaaaaaaaaaatcaggagcaaattgaaaccgagctgaagttacgtgcttgcctttttcagtatgttgtcgcgtatcacgtttgaggtggatcgtatctgccggtcagtacgcagtgtttgggcaaatacttggctacttgggagtcgcaagaaattgtgtaaattatatagaggaggatggcgacgaagcacgcatgtgttacgtagttggggtttgtgtgcacatggtggtgggcaggggctaggagagggtttatctttaggttattttcgtagtggaatgaatcttatgatcggatatccatcgtcggaaggtgtggcgggctgctggtcaagataggtggcttctatgactatgagggttgaaacaacaagtggacgattctgtcctgtggtcactgctcatcatccaatctagcggctttgacggtcgtgcctttttagtatcaataatattattccaagtttaaaaaaaaaaaaaaaaaa

SEQ ID NO: 200 - protein, 498 aa, Zea mays
MSTCAADLAPLLGPAAANATDYLCGQFADTASAVDATYLLFSAYLVFAMQLGFAMLCAGSVRAKNTMNIMLTNVLDAAAGALFYYLFGFAFAFGTPSNGFIGKQFFGLKHLPRTGFDYDFFLYQWAFAIAAAGITSGSIAERTQFVAYLIYSAFLTGFVYPVVSHWFWSADGWAGASRTSGPLLFGSGVIDFAGSGVVHMVGGIAGLWGALIEGPRIGRFDHAGRSVALKGHSASLVVLGTFLLWFGWYGFNPGSFTTILKSYGPAGTVHGQWSAVGRTAVTTTLAGSVAALTTLFGKRLQTGHWNVVDVCNGLLGGFAAITAGCSVVEPWAAVICGFVSAWVLIGANALAARFRFDDPLEAAQLHGGCGAWGVLFTGLFARRKYVEEIYGAGRPYGLFMGGGGKLLAAQIIQILVIAGWVSCTMGPLFYALKKLGLLRISADDEMSGMDLTRHGGFAYVYHDEDPGDKAGVGGFMLKSAQNRVEPAAAVAAATSSQV

SEQ ID NO: 201 - DNA, 1832 bp, Zea mays
cttggagtcgtcgtcgtgcagctcgtccgacgagagcctggtcaagagaaccggtgagtagtcgtcgatggatccattccacgcgccaagctgtaatcctacctgcacggcgatggggcggtcagaaggcggcgacggggacggcgacggcgaccggctcctcctcggcaagcccttgcagtcgtcgtcgtcgtgcacgctcgtccgacgagagcctgctcaagagaaccggcacggtatggacggcgatggcgcacatcatcacggcggtgatcgggtccggcgtgctgtccctggcgtggagcgtggcgcagctggggtgggtgggcgggcctgcggcgatggtgttcttcgccggcgtcaccgcggtgcagtccaccctcatcgccgactgctacatctgccaccacccggagcgaggaggcgtcgtcaggaaccgctcctacgtcgacgccgtgcgcatctacctgggcgacaagagccatttgttttgcggcttcttcctcaacctgagcttgtttggcaccggtgtggtgtacacgctcacttccgccactagcatgagggcgatccggaaggccaattgctaccacagggaaggccacgacgcgccgtgctcggtgggaggagacggctactacatgctgctcttcggcctcgcgcaggtgctgctgtcgcagatacccaacttccacgagatggcggggctctccatcttcgccgccgtcatgtcctgcttctacgccttcgtcggcgtcggcctcggcgtcgccaaagtcatcgcaaacggggtgatcatgggcggcatcggaggcatcccgctggtgtccacgacgcagaaggtgtggcgagtctcgcaggccctcggggacatcttgttcgcctaccctttctcgttggtgctgctggaaatagaggacacgctgaggtcgccgccgccggagagcgagacgatgaaaaaggcgacgagagcgagcatcgctatcaccaccctcttctacctctgctgcgggtgctttggctacgcgtcgttcggcgacggcaccccgggcaacctcctcaccggcttcggcttctacgagccctactggctcatcgacctcgccaacctcgccatcgttctccacctcctcggcggctaccaggtgtacacgcagccggtgttcgcgttcgcggaccgcaagttcggcggcggggccacgatcgtcgaggcgccgctgctgccggtgccgggcgcgcgccgcgtgaacgtgttcaggttgtgcttccgcacggcgtacgtggcggcgaccacggcgatggccgtctggttcccctacttcaaccagatcatcgggctgctcggctccttcaccttctggccgctcgccgtctacttccccgtcgagatgtacctcacgaggaacaaggtggcgccgtggaccaaccagtggctcaccatccatgcattcagcctcgtctgcctgctcatcagcgcgttcgcctccgtcggctctgcggttggcgtgttcgggtcggagacgagctgattcaaactctgcaaatgcaattgccggccacttttcggacatgcatgttctgtgcatatactgcgcttgtacatttagcgttatacctagtactggaacggtcaggccgggccccgagcctcgtgcttaggctcaaacgggtctgggcccagaaggtccaaatttttttggatcataccgtgtcagcctaaagagtagaaatagtggtttagccaggctctaaaacactttctatctttgttgggccatgccgacccatatatttaaaccatataaaattcaaataaaaaaaaaaaaaaaaaa

SEQ ID NO: 202 - protein, 395 aa, Zea mays
MVFFAGVTAVQSTLIADCYICHHPERGGVVRNRSYVDAVRIYLGDKSHLFCGFFLNLSLFGTGVVYTLTSATSMRAIRKANCYHREGHDAPCSVGGDGYYMLLFGLAQVLLSQIPNFHEMAGLSIFAAVMSCFYAFVGVGLGVAKVIANGVIMGGIGGIPLVSTTQKVWRVSQALGDILFAYPFSLVLLEIEDTLRSPPPESETMKKATRASIAITTLFYLCCGCFGYASFGDGTPGNLLTGFGFYEPYWLIDLANLAIVLHLLGGYQVYTQPVFAFADRKFGGGATIVEAPLLPVPGARRVNVFRLCFRTAYVAATTAMAVWFPYFNQIIGLLGSFTFWPLAVYFPVEMYLTRNKVAPWTNQWLTIHAFSLVCLLISAFASVGSAVGVFGSETS

SEQ ID NO: 203 - DNA, 1949 bp, Zea mays
acgcgcccacgcctccgctgagagaataggttctgtgcgagggctccctcgcactccgcaagcacgccaacctcagtcgccagccagccatggcgtctgattccggcaccgcctcctcggacccgctcctccacggccgccgcgcgccgtccacgggcggctggaaatccgccctcttcataatttgggtagaggtggcggagcggttcgcgtactacggcatctcgtcgaacctgatcagctacctgaccggcccgctcggccagaccacggcggcggcagccgcggcggtgaacgcgtggtcgggcgccgcgtccatgctgccgctcctcggcgccgccgtcgccgactcctggctcgggcgctaccgcaccatcgtcgcctcctccgtgctctacatcacgggccttgggatgctgacgctgtcatcagttttctcatcgcctcagcaatgccgtgactccgccgacgacggagaaggtatatgcccgccttcctcgcttcagacggccttcttctacgcctccctctacttggtggccatcgcccagagcgggcacaagccctgcgtgcaggccttcggcgccgaccagttcgacgcgacagaccccgacgagtccgtgtcccgggcatccttcttcaactggtggtacatgggactgtgcaccagcgccaccgtgacaattgcgctcatgagctacgtgcaggacaacgtgggctgggccctcggcttcggcgtgccgtccatggccatgctactcgcgctcgccatcttcctgctcggcacgaggacctacaggttctacggctcccgcggtggtgctggtgccagtgccagcgcgtcgtcccttttccgcaacgcgttcgtggcctggaggaaaaggtcgcgtgaagtggagctgggacatggtgagctcgcccaggacgatgccgtgctcgcggaagaggtgaaggggctggcgaggctgttcccgatatgggcgacgtgcctgctctacggcgcggtgttcgcgcagccgcccacgctcttcacgaagcaggcggcgacgctggaccggaggatcgggcggtcgttccaggtacctcccgcggcgctgcagtgcttcctcggcgccagcatcgtcacctgcatcgtgctgtacgaccgcgtcctggtgcccgtgacgcgcagggtctccggcgccgcctcgggcatcaccatgctgcagcggatcggcacggggatcgcgctgtcccttgtcactctagtcgtcgccgtgctggtggagatgaagcggctgcgagcggcgagggacgccggcggcggcggcctggtggacggctctggcaccggcacggcggcggtccccatgagcctgtggtggatcgtgccgcagtacgtgctgctcggcgccgcggacgtgttcacgatggtcggcatgcaggagttcttctacgaccaggtccccggggccctcaagagcctcgggctggcgctctacctcagcgtcctcggcgtcggcagcttcatcagcagcttcctcatcacggtgattgatgccgttacgacgaggaacggaggcaccagctggttcgccgacgacctcaaccggggtcacctagactacttctacctgctccttgcagcgctcgccgcgctggagcttctcgctttcgcttacttctcaacgtcttacgtttacaagacaaaggcaggcaatctctaatctccgtggacagaggcatgcatgtcagcatatgtatgtttattatagatagaaggattgcatggcagcgttcttcagtgtccttgcaaactaaaatgggctgcgtttagcgcgcagacagcaaagtactagaggctatcgggaaattgtaaaatggaggtgtactacggtcacaagtggggcacaataataatgaaattacgtgcttcacaaagcataaaattgtgcaaaaaaaaaaaaaaa

SEQ ID NO: 204 - protein, 538 aa, Zea mays
MASDSGTASSDPLLHGRRAPSTGGWKSALFIIWVEVAERFAYYGISSNLISYLTGPLGQTTAAAAAAVNAWSGAASMLPLLGAAVADSWLGRYRTIVASSVLYITGLGMLTLSSVFSSPQQCRDSADDGEGICPPSSLQTAFFYASLYLVAIAQSGHKPCVQAFGADQFDATDPDESVSRASFFNWWYMGLCTSATVTIALMSYVQDNVGWALGFGVPSMAMLLALAIFLLGTRTYRFYGSRGGAGASASASSLFRNAFVAWRKRSREVELGHGELAQDDAVLAEEVKGLARLFPIWATCLLYGAVFAQPPTLFTKQAATLDRRIGRSFQVPPAALQCFLGASIVTCIVLYDRVLVPVTRRVSGAASGITMLQRIGTGIALSLVTLVVAVLVEMKRLRAARDAGGGGLVDGSGTGTAAVPMSLWWIVPQYVLLGAADVFTMVGMQEFFYDQVPGALKSLGLALYLSVLGVGSFISSFLITVIDAVTTRNGGTSWFADDLNRGHLDYFYLLLAALAALELLAFAYFSTSYVYKTKAGNL

SEQ ID NO: 205 - DNA, 951 bp, Zea mays
gccagtgagctagcctcccgagccctatctatccttttctcggcacctcgcgggtctcccgtccgccccgtcccgcattcgtatcctctcctcactctcgccgccgccgcttcccctgcgccccgagccaagatgaatgttgaaaagctcaagaagatggcaggtgctgtgcgcactggggggaagggtagcatgcgcaggaagaagaaggcagtccacaagactacgaccacagatgataaaaggcttcagagcaccctgaaaagaataggagtgaacaccattcctggtattgaagaggtcaacatctttaaggatgatgttgttattcagtttgtgaatcctaaagtgcaagcttcaattggtgctaatacatgggtggtcagtggaactccacagacaaagaagctgcaagatctgcttccgtccattatcaaccagctcggccctgacaacctagacaacctgcggaggcttgcggagcaattccagaagcaggcccctggtgcttcaggtgcagaggctggcgccagcgctggtgctgctcaggacgatgacgatgacgttcctgagctcgtccctggagagacatttgaggaggctgcggaagagaaaaaggagtcgtcatgattttgccacatgcccgcccttttgaagggcttataagtaaatccttgcgtagaagggacatgttgaactctgacctaccttatttgtgcctgcttacggttatgtcatgaacgagaatttggtagtccagcgctggtccccctttttcacccatatccccgtgcttgtgtggtaaaagtcttgttaatgttaaaggccacacttaaaccaaatcaaggtaccatgtctccggtaccatgcttcacgaagatttacccctaggtaccatgcttcacgaagatgaataccagatgtcagttcacctgccaaaaaaaaaaaaaa

SEQ ID NO: 206 - protein, 165 aa, Zea mays
MNVEKLKKMAGAVRTGGKGSMRRKKKAVHKTTTTDDKRLQSTLKRIGVNTIPGIEEVNIFKDDVVIQFVNPKVQASIGANTWVVSGTPQTKKLQDLLPSIINQLGPDNLDNLRRLAEQFQKQAPGASGAEAGASAGAAQDDDDDVPELVPGETFEEAAEEKKESS

SEQ ID NO: 207 - DNA, 1798 bp, Zea mays
cccaccgctagtagttgttgtagtactatactacactcctctccttcttggctagctagcaattcaaccagctctctctctctctctcttttgtatgtatgtatatgtgtatataaataaccgtgcacgcagtgtgactagcaagcagtacacagaggatctggtaagcaactaagcaagtgtactgaggacggaggcatcgatccagcgttccagctagcacgcacgcagccagcacccagcacccagcagtagaatctatatatcgtacgcaagtagtggatcgaggcatctatctgcagtccctttcttcttcttcctcttgattgataggtgcgccgaagcttgttttgttgggtggcctttgtctctgtcgtctcgtctcgtctcgtcttccgcccggccgccaccacctgcaggctatactagctagctattaagtccggccaaccaagcagctcgatcaggtcggtcgacggcggggacagttcggagggaggaggcggccggagaccgaaggacgcctaccatcaactcgcggtcctggccgcgctgccgaaaaattaaaggaagaggacgaaggctgaccgatggacgatcgttatcctcatcatcagtcgtcgatggcgacaccggcagcagcgagcaagatgagcaagaagctgcagggcggtggtgaccgtagtagtggcagtagtagtaggggcagcggcaacagtgataagcagcaggtgccggcggcggcgatgaggaagggcccgtggacagaggaggaagacgctcagctggtatggttcgtccgcttgtttggtgaacgccggtgggatttcttagcaaaggtctcaggtttgcgcggtctgaggcgcaccggcaagagctgccgcctccgctgggtcaactacctccacccggggctccggcgcggccgcatcaccgccgacgaggagcgactcatcctccagctccacgcgcagtggggcagccgctggtcgcgcatcgccaggagcctccccggccgcaccgacaacgagatcaagaacttctggaggacgcgcgccaggaagcagaaggcggcggcgcagcagcagcagcagcagcaggacagccggagcagcaagacggcgacggcgtcggcgttctcagggtcagcgtcgtccgtgactaccaccacgtccagctgctctggctctcctagtccgaccagccgcggctgtggcacggccacgtcatcgtccgctctgaccgagtccgcgctgcggcaaagcggcggcgaagacgaggacgccgagctcgacgaggcgtccaccaccaccaccaccacggcaagccagcgtcaacaccaagacgacgaccaccagcagcagcaccaggagtgctacgcctcggaccacttctggaacgacatcgcggcggcggaggcggccatctacatgttgatcgacggcggctggacagggtccggccccggccatcccgccgccgatccgccttcgtcgccggcgtgggagtactgctctgattactcgctctggaggatcgacgacgacgagtactacgagaagatgctcgactcctcctcctgattcgattatccagccatcacacgcatatgcatatctatcattagcttatttctttcttttttttgtgctgattagtctagcatacagcagctatgagaatccaaagcttcggttcggctttcgttgcatctctttgtataatactgtaacatatctatatatatatatgtatgatatgatactgctctcgatcaaaaaaaaaaaaaaaaaaaaaa

SEQ ID NO: 208 - protein, 330 aa, Zea mays
MDDRYPHHQSSMATPAAASKMSKKLQGGGDRSSGSSSRGSGNSDKQQVPAAAMRKGPWTEEEDAQLVWFVRLFGERRWDFLAKVSGLRGLRRTGKSCRLRWVNYLHPGLRRGRITADEERLILQLHAQWGSRWSRIARSLPGRTDNEIKNFWRTRARKQKAAAQQQQQQQDSRSSKTATASAFSGSASSVTTTTSSCSGSPSPTSRGCGTATSSSALTESALRQSGGEDEDAELDEASTTTTTTASQRQHQDDDHQQQHQECYASDHFWNDIAAAEAAIYMLIDGGWTGSGPGHPAADPPSSPAWEYCSDYSLWRIDDDEYYEKMLDSSS

SEQ ID NO: 209 - DNA, 1398 bp, Zea mays
gcttgctggctagggtaggcttctgttcatgctgctgctgagccaacgcggccgtcctcatcctgttcctgtcatccatccactctctctcctctccctccctccctcctctcctctcctctcctctcgtctctctctctctctcgtcgctattggctagttcgcgcgtcttgttccataaataggagtagtaggcagttcctcgctggtcctttgcgcaaaagagtactctctccctcctaccacacacagcctccggactgctccggacgcgcgcctcagatctactccaacacctccgcagcggcggcgcccgcgggtggaggagcaggagaggcggcgccatggtcgggaccgggaagagggagcggatagcgatacggaggatcgacaacctggcggccaggcaggtgaccttctccaagaggcggcggggcctgttcaagaaggccgaggagctctccatcctctgcgacgccgaggtcggccttgtcgtcttctccgccaccggcaaactcttccacttcgccagctccagcatgaagcaggtaatcgatcggtacgactctcattccaagactctccagaggtccgaaccgcagtcgtctcaactgcagtcacatatggatgacggcacttgtgcaaggctaaaggaggaacttgctgaaacaagccttaagctcaggcagatgagaggagaggagctccagaggctgagcgtcgaacagctgcaggagctcgagaagaccctcgaatccggcctcggctctgtactcaaaaccaagagccaaaaaatccttgacgagatcagcggtctggaaagaaagagaacgcagctgatcgaggagaactcaaggctgaaggagcaagtgacacggatgtcgaggatggagacgcagcttggcgccgatccagagttcgtgtacgaggaagggcagtcgtctgaatccgtgacgaacacgtcctatccgcgcccgtccaccgacaccgacgactgctccgacacatcgctcaggctcgggctaccactcttcagctccaagtgacggagatttgacatgtccggtagcggagcggtgccgattgcttgcccttctccactctagataggtctggattgggggagagcaagcactgctggatcgggaagacccaagtgaccaacgcgtcgcatcagaataaggcattttgagtgctgtatgatgtgtgtattctggctctgaaagtgagacctgcttttgttataatacatacatacaggcagcatggcaatacgtgacggggtatccgctgcctgcagtccgtgacctgtctgtcgtctctgtttctagtaaaaaaaaaaaaaaaaaaaaaaaaaaaaaaaaaaaaaaaaaaaaaaaaaaaaaaaaaaaaaaaaaa

SEQ ID NO: 210 - protein, 233 aa, Zea mays
MVGTGKRERIAIRRIDNLAARQVTFSKRRRGLFKKAEELSILCDAEVGLVVFSATGKLFHFASSSMKQVIDRYDSHSKTLQRSEPQSSQLQSHMDDGTCARLKEELAETSLKLRQMRGEELQRLSVEQLQELEKTLESGLGSVLKTKSQKILDEISGLERKRTQLIEENSRLKEQVTRMSRMETQLGADPEFVYEEGQSSESVTNTSYPRPSTDTDDCSDTSLRLGLPLFSSK

SEQ ID NO: 211 - DNA, 953 bp, Zea mays
agctagccagccatcctactgtcacacacacacacacacacagacaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggccagcggcgagaagaagcaccaccacctcttcggctgaccgtagtaccggccggcgcgcgaccgagctagctagctccggcgcacacaaccacacacctgtttaattctgtactgcatgcgtgtgtaatttgatggttcacaataatgagtccctctccggaccttggtagctgcttgcttgtggtgagtgagagtgtgagactgagggagaagaggtggtgggcgtggggctacgtcgagagaggcgtgttcctgtaatcctgtactcgcttcgttttctctgcatgcgtctataattgtgttcaataataagtgagagcggtgtgatgtgtggctccccttgtcaggctcatgtttatccgtattgaatcctggcaccatgcatgactgaggatctggatgtctatgaagcaccgtgtatctatcatcacttttgcaaaaaaaaatattcttatatttctcgaaaaaaaaaaaaaaaaaaa

SEQ ID NO: 212 - protein, 131 aa, Zea mays
MSEEKHHHFFNHHKKDEEQPAGEYGYSETEVVTATGEGEYERYKKEEKEHKHKQHLGEAGAIAAGAFALYEKHEAKKDPEHAHRHKITEEVAAAAAVGAGGYVFHEHHEKKKDHKDAEEASGEKKHHHLFG

SEQ ID NO: 213 - DNA, 3455 bp, Zea mays
ggctcggagattcttctcgcgtttctcctgcactttccgtctgatatttatcagcttcttacttcagtccagcagagttcctttgcttcattgctcgctttgaaggggatttttactgctagtctctgagccgtcaaatttttcaccactcagctgtactcccccacgtccaccaggcaagaacagcaacgtcagtttgcagcagaagaaaaggctctccctccctttgtattgaaagcacaaaaaatcctctttatctctctgactccttcccctcactcacaggtggctgcttgttgagtccagtgtgtcagtgtgtgccacttctctcacaaacactgcgagcttgtccctatcctgcaagaaacagcggaccaaagcatccgctccatttctccgctagttcgtgcgtcgatccaaacgccaatcttggatttctgccgcaaggactgtgcttcttgtagcaaaagcccccaaagatttgatccaagccagctcggaatcggatccctgcgaggaccaggcggcctgccatggcgtcccgctcctactccaacctcctcgacctggcaaccggagcagcggaccaggcgccggcggtcgcggcgcttggcgcgctccggcggcggctgccgcgcgtggtcaccacccccgggctcatcgacgactcgccggcgtcgccgtccacgccgccgcggccgcgcaccatcatcgtggccaaccagctcccgatccggtcccaccgcccggagtcgccggaggagccctggaccttcgagtgggacgaggactccctcctccgccacctccaccactcgtcgtcccccctgatggagttcatctacatcggctgcctgcgcgacgacatcccgcaggccgagcaggacgccgtcgcgcaggcgctcctcgagacccacaactgcgtgccggccttcctgcccacggacatcgccgagcgctactaccacggcttctgcaagcagcacctgtggcccctcttccactacatgctgccgctgtcccccgacctcggcggccgcttcgaccgcgcgctgtggcaggcctacgtctcggccaacaagatcttcgcggacaaggtgctggaggtgatcaacccggacgacgacttcgtgtgggtgcacgactaccacctcatggtgctcccaaccttcctgcgcaagcgcttcaaccgcatcaagctcggcttcttcctgcactcgccgttcccctcgtccgagatctacaagacgctccccgtgcgcgaggagcttctgcgcgccctgctcaactccgacctcatcggcttccacaccttcgactacgcgcgccacttcctctcctgctgcggccggatgctcgggctctcgtacgagtccaagcgggggcacatttgcctcgagtactacggccgtacggtgagcatcaagatcctgcctgtgggggtgcacatggagcagctcaagacggtgctcgggttgccggagaccgaggccaaggtgtccgagctgatggagatgtactctggaaaggggagagtggtcatgctaggcgtcgacgacatggacatcttcaaggggatcagcctcaagctccttgccatggaggagcttctgcggcagcaccccgagtggcgggggaagctggtgctggtgcaggtggccaacccggcgcgagggagggggaaggacgtcgccgaggtgcagaccgagacgtacgccatggtgcggcgcatcaacgaggtgtacggtgagccggggtacgagccggtggtcctgatcgatgagcctctgcagttctacgagcgcgtggcctactacgtcatagccgaggtgtgcctggtgaccgcggtcagggacggcatgaacctgattccctatgagtacatcgtctcccggcaggggaacgagaagctggacaggatgctgcggcaggggaagccagaggagaagaagagcatgctggtggtgtccgagttcatcgggtgctcgccgtctctgagcggcgccatcagggtgaacccgtggaacatcgaggccgtggctgacgccatggagaccgcccttgtgctgcctgagaacgagaagaggctgcgccacgataagcacttccgctacgtgagcacccacgacgtcgggtactgggctaacagcttcctcctggaccttgagaggacctgcaagtatcattctcagaagaggtgctggggcattggcttcggcctgcggttcagagtggtctcgctcgacctgaccttcaggaagctttccttggagaacatccttatggcataccggagagccaagacacgggcaattctgctggactacgatggcacgctgatgccacaggcgattaacaagagcccgtcaactgaatctgtgcggatcctcaacagcctgtgccgagacaaggacaatgtggtgtacctatgcagcgggtatgaccggcgcacccttcatgagtggttcccttgtgagaaccttggcatagccgcggagcatggctacttcctgaggtgtaagagggacgcggaatggaagacctgtgtcgctgccacagactgcagctggaagcagatcgcggagccggtgatgtgcctgtacagggagacgacggacggctcaaccatcgaggacagggagacggtgctcgtgtggaactacgaggacgcggaccccgacttcgggtcgtgccaggccaaggagctcgtcgaccaccttgagagcgtgctcgcgaacgagcctgtgtcggtgaagaccacgcctcactcagttgaagtgaaaccgcagggcgtgagcaagggcttggtggcccggcgcatgcttgtgtcgatgaaggagcggggccagtgcccggacttcgtcctgtgcatcggcgacgacaagtccgacgaggacatgttccagctgatcgccaccgctgcctgcggggactcgctggcgtccaaggcggaggtgttcgcgtgcaccgtcggccgcaagcccagcaaggccaagtactacctcgacgacgcggcggaggtggtgaggctgatgcaggggctctcctacgtctccgaggagctggcgctggcgaaccagcgggatgaagacgaggactcctctctggacgacgtgtgggagtaggaaggagcgttcccttcccgtgctgctcctgcggtaatgtctgtttgtgttggctcggctggagctttcgccgagtagtttaggtgtgtaaatgaggtatgctttccagcgtaatgtattgccagtggtctagtctcgagagctggcttgaatctagtgatgctctagtactttggtttgtggtgctatttacctgatccgtggaaggcagtactatgagctatacaagatgcagacctgaaatctcattcatctgaagaccatgacctttctcctaggcgtgtgtatacccccttggattttggaactaaaaaaaaaaaaaaaaaaaaa

SEQ ID NO: 214 - protein, 863 aa, Zea mays
MASRSYSNLLDLATGAADQAPAVAALGALRRRLPRVVTTPGLIDDSPASPSTPPRPRTIIVANQLPIRSHRPESPEEPWTFEWDEDSLLRHLHHSSSPLMEFIYIGCLRDDIPQAEQDAVAQALLETHNCVPAFLPTDIAERYYHGFCKQHLWPLFHYMLPLSPDLGGRFDRALWQAYVSANKIFADKVLEVINPDDDFVWVHDYHLMVLPTFLRKRFNRIKLGFFLHSPFPSSEIYKTLPVREELLRALLNSDLIGFHTFDYARHFLSCCGRMLGLSYESKRGHICLEYYGRTVSIKILPVGVHMEQLKTVLGLPETEAKVSELMEMYSGKGRVVMLGVDDMDIFKGISLKLLAMEELLRQHPEWRGKLVLVQVANPARGRGKDVAEVQTETYAMVRRINEVYGEPGYEPVVLIDEPLQFYERVAYYVIAEVCLVTAVRDGMNLIPYEYIVSRQGNEKLDRMLRQGKPEEKKSMLVVSEFIGCSPSLSGAIRVNPWNIEAVADAMETALVLPENEKRLRHDKHFRYVSTHDVGYWANSFLLDLERTCKYHSQKRCWGIGFGLRFRVVSLDLTFRKLSLENILMAYRRAKTRAILLDYDGTLMPQAINKSPSTESVRILNSLCRDKDNVVYLCSGYDRRTLHEWFPCENLGIAAEHGYFLRCKRDAEWKTCVAATDCSWKQIAEPVMCLYRETTDGSTIEDRETVLVWNYEDADPDFGSCQAKELVDHLESVLANEPVSVKTTPHSVEVKPQGVSKGLVARRMLVSMKERGQCPDFVLCIGDDKSDEDMFQLIATAACGDSLASKAEVFACTVGRKPSKAKYYLDDAAEVVRLMQGLSYVSEELALANQRDEDEDSSLDDVWE

SEQ ID NO: 215 - DNA, 2203 bp, Zea mays
caataattcccttccgcctctcctcccgtcctctcgcaagcccacaccacacctgcagaaatcacagcggcaggtgcagcaaaaatctccatgcccccgctcggctagatctccgacgagccggccccgcgcggtagcagattcgctcccctatcccgaccgatgggcggtgaggtgccggagccgcgccggctgagccgcgcgctcagcttcggctgcggcggcgtccccgaggaggcgctgcacctcgtgttcggctacatggacgacccgcgagaccgggaggcggcctcgctcgtgtgccgcctctggcaccgcatcgacgcgctctcgcgcaagcacgtcaccgtgggcttctgctacgccgtggagcccgcgcggctgctcgccaggttcccgcggctcgagtcgctcgcgctcaaggggaggccccgcgccgccatgtacgggctcatccccgaagactttggcgcctacgcggcgccctgggtcgccgagctcgccgcgccccttgactgcctcaaggcgctccacctgcgtcgcatgaccgtcaccgacgaggacatcgccgtgctcgtccacgcgcgcggccacatgctacaggcgctcaagctcgacaagtgctccggcttctcaacagacgccctccgcctcgtcgcgcgctcctgcaggtatctgagaaccttgttcctggaagaatgtataattgaggatgaagggagtgaatggctccatgaactcgctgtcaacaattctgttctggtgacactgaacttttacatgacagaactcaaagtggagcctgctgatctggagcttcttgcaaagaactgtaaatcattgatttctttgaagatgggtgactgtgatctttcagatctgattgggtttttccaaacctccaaagcattgcaagaattcgccggaggtgccttttttgaagttggagagtacaccaagtacgaaaaggtcattttcccacctaggctatgcttcttagggggtcttaccttcatgggtaaaaacgagatgccagttatctttccgtattccacaatgcttaagaaactggacttgcagttcactttcctcaccactgaagaccactgtcagcttattgctaaatgccccaacctaagtgttctcgaggtgaggaatgtgattggggatagaggactagaagttgttgctgctacatgcaagaagctacgaaggctcagaattgagcgtggcgacgatgatcctggccaagaagagcagggaggagtctctcagataggtttgacagccgtagccgttggctgccgcgaactagagtacatagctgcctatgtatctgatatcacaaatggggcgctggaatccattggcactttctgcaagaatctatatgatttccggcttgttctacttgacaaacagaagaagataacagacctgccacttgacaacggcgtccgtgccctactgaggaactgcgtcaaacttcggaggtttgccttctacctgagacctggagggctttcagacgtaggcctcggttacattggactatacagtgggaacatccaatacatgctactcggcaacgttggtgaatctgacaacggattgatccagtttgcaacgggatgcaccaacctgcggaagctcgagctgaggggctgctgcttcagcgagcgagctctggcagtggccgtgctccagatgccctcgctgaggtacatatgggtgcaggggtacagagcctctcgaacgggccaggacctcatgctcatggccaggccgtactggaacattgaattcgcgcctcccagtcccgagagcgcttatcgggtgatggcagatggacagccttgtgttgacacccatgcccaggtccttgcgtattactcccttgctggaaggaggccggactgccctcagtggctggtgactttgcaccctgcgtcactgtaaatacgtcaagctgtcccgagtgtggtttttgtaccagctgcttgtgtaccgtaataaactctagtactgtagtggtggaggcgtagtgcaataaagttgcagttgttgcttgtactagtgaatctaatcctaggaggttgttgccctgtgctttcttttccccggaattgtatctttgctccactgtaaatatcagaaatggcttactagagttttggctgtgctaaaaaaaaaaaaaaaaaaa

SEQ ID NO: 216 - protein, 598 aa, Zea mays
MGGEVPEPRRLSRALSFGCGGVPEEALHLVFGYMDDPRDREAASLVCRLWHRIDALSRKHVTVGFCYAVEPARLLARFPRLESLALKGRPRAAMYGLIPEDFGAYAAPWVAELAAPLDCLKALHLRRMTVTDEDIAVLVHARGHMLQALKLDKCSGFSTDALRLVARSCRYLRTLFLEECIIEDEGSEWLHELAVNNSVLVTLNFYMTELKVEPADLELLAKNCKSLISLKMGDCDLSDLIGFFQTSKALQEFAGGAFFEVGEYTKYEKVIFPPRLCFLGGLTFMGKNEMPVIFPYSTMLKKLDLQFTFLTTEDHCQLIAKCPNLSVLEVRNVIGDRGLEVVAATCKKLRRLRIERGDDDPGQEEQGGVSQIGLTAVAVGCRELEYIAAYVSDITNGALESIGTFCKNLYDFRLVLLDKQKKITDLPLDNGVRALLRNCVKLRRFAFYLRPGGLSDVGLGYIGLYSGNIQYMLLGNVGESDNGLIQFATGCTNLRKLELRGCCFSERALAVAVLQMPSLRYIWVQGYRASRTGQDLMLMARPYWNIEFAPPSPESAYRVMADGQPCVDTHAQVLAYYSLAGRRPDCPQWLVTLHPASL

SEQ ID NO: 217 - DNA, 1756 bp, Zea mays
gtcctcttcttgttcccaaacctcaccgcctcaactgcttcgccttcgactgcgggcggcggcggcggcgtacaaagaaccaaaagatgactccttgcgctctcaccgtcgactccctaaacccaaaggtgctggctctcgcggatcacctcggcgacaacgccattgcccgccgcgcgcagtgcatccagaacgagatagaagcagaaccggagtcacaccctttccgcgagataatcgattgcagcctcagcaatccacagtccatgggacagcggccaaacaagttcttccgagaggttcttgccttgtgcaaccatccccatcttctagaacagagtggaactaattccttgttcagctctggtgcgatagcaagggcacgggagattctagacctctttcccgggagagcaacaggaggatatagccactctcagggcactgaaggattgcgcgacataatcgccgctggaatagccgctcgagataatttcccctgcaacgcggatgacattttcctgacagatggagcagctccgccggttcacatgatgatgcacctgctgatacgggatcaaaaagacggcatcctctgcccagttccatcgcattccttgtacacgagtgctatgcttctccagggcgctactcttgtgccatatttccttgacgagtcaagaggctggggagtgagcatgtcagacctgaagaagcagctggatagtgcccggtcaatgggtgtttttgttagggggcttgtggttataaatccaggcaaccctactggacatgttctcgtggaggaaaatcagcgtgagattgtggatttctgcaggaatgaagatcttgttcttctagcagacgaggtttaccaggaaaatatttacgcagatgagaagggatttcactctttcaagaagatagcacggtccatggggtacggcgaaggagacatatctttagtgtccttccattcagtttctaatggataatatggtgaatgtgggagaaggggaggctacatggaagtcactggcttcaactctgatgtaaagaaacaagtgtacaaagttgtatccctaagctcgtgctccaacatctccggccagatcctcatgagcctagtcatgaacccgccacaggtcggagacgagtcgtacgcctcttaccatgccgaaagagacggcgtcctgtcatctttcgctcgctgcgcagaggccatggtgcgctcattcaacgggctggaaggggtgacctgtagcgaggctgaaggagcagtgttcgtgttcccttcagtccgtctgccaaagaaggcggtcgcagctgccgaggcaagcaacacgcagccagatgcgttctacgcgctccgcttcctcgaaaccaccgggatcgtcgttgtgcctggctctgtttttggacagatgcatggaacgtggcatttcagatgcacggtcctgccacacgaagagaagaagatgacggtgatcatctccagctttgtggcgtttcatcgagccttcatggaagagtttcgcgactaacagatttcagctcctcttcttctatctctgtattgtaccacaacttaatgctgtacttcggagaaaacctagacctctccaaatgcatgattcctgtatgaaactgtttgagtttttctttttcttttgttgttgtgtctgttacggctattttagtccaacgcaactaattatatatatatatataggcaggtaaaaaaaaaaaaaaaaaa

SEQ ID NO: 218 - protein, 302 aa, Zea mays
MTPCALTVDSLNPKVLALADHLGDNAIARRAQCIQNEIEAEPESHPFREIIDCSLSNPQSMGQRPNKFFREVLALCNHPHLLEQSGTNSLFSSGAIARAREILDLFPGRATGGYSHSQGTEGLRDIIAAGIAARDNFPCNADDIFLTDGAAPPVHMMMHLLIRDQKDGILCPVPSHSLYTSAMLLQGATLVPYFLDESRGWGVSMSDLKKQLDSARSMGVFVRGLVVINPGNPTGHVLVEENQREIVDFCRNEDLVLLADEVYQENIYADEKGFHSFKKIARSMGYGEGDISLVSFHSVSNG

SEQ ID NO: 219 - DNA, 2351 bp, Zea mays
agcaactgacaggcacctgacggagagctagtcgctctgcagccgagtcgagtcgaactagcgcgcgagcgagcgaggaagaagaagagctagctatactgctgcttcctcgcgcgcagcagcagcagcaaacgaagaaaccagccccatgggcggcagcgcggatgcgaacggcgcggggtcggtgcgggtgccggtgccgccggcgcggccgttcctggacacgttccgcgggaacctcaaggagaccttcttcccggacgacccgttccgcggggtggtgcgggagcgcggggccgggcggcggaccgtggccgcgctgcgctacttcttcccgttcctcgagtgggcgccggcctacgcgctgtccaccttcaagtccgacctgatcgccggcatcaccatcgccagcctcgccatcccgcagggcatcagctacgccaagctcgccaacctgccgcccgtgctcggactctactcgagcttcgtgccgccgctggtgtacgcgctgatggggagctccaaggacctggcggtggggacggtggcggtggcgtcgctgctcatcagctccatgctcggcagcgaggtgtcgccgacggagaaccccgtgctctacctgcacctcgccttcaccgccaccttcttcgccggcgtcttccaggcctcgctcggcctcctcaggttgggcttcatcgtggacctgctgtcgcacgcgacgatcgtggggttcatggccggcgcggcgacggtggtgtgcctgcagcagctgaagggcatgctgggcctcgtccacttcaccacctccaccgacgtcgtctccgtcatggaatccgtcttcagccagacacaccagtggcggtgggagagcgtcctgctcggctgcggcttcctcttcttcctcctcgtcacccgcttcatcagcaagaggcgtcccaagctgttctggatctccgcggcggcgccgttgacgtccgtcgtgctcgggagcgttctggtgtacctcacgcacgctgaaaaccacggcatcgaagtgatcggttacctgaagaaaggcctgaatccaccgtcggtgacaagcctgcaattctcaccgccctacatgatgctcgcgctcaagactgggatcatcaccggcgtcattgccctcgccgaaggcatcgccgtggggaggagcttcgccatgttcaagaactaccacatcgacggcaacaaggagatgatcgcgatcgggacgatgaacgtcctgggctcgctcacgtcgtgctacctgaccacgggscccttctcgcgctccgccgtgaactacaacgccgggtgcaggacggccatgtcgaacgtggtcatgtcgctggcggtgatggtcacgctgctgttcctgacgccgctgttccactacacgccgctggtggtgctgtcggcgatcatcgtctccgcgatgctgggsctggtcgacttcggggccgcgctgcacctgtggcgcgtcgacaaggtcgacttctgcgtctgcgccggcgcgtacctgggcgtcgtcttcggcagcgtcgaggtcggcctggtcgtcgccgtcgccgtctccctgctccgcgtcctgctgttcgtcgcccggcccaggaccacggtgctcggcaacatccccggcaccatggtgtaccggaggatggaccagtacgccgccgcgcagacggtgcccggcgtgctcgtgctgcgcgtcgacgcgcccgtctacttcgccaacgccagctacctgcgagagaggatctcgcggtggatcgacgacgaggaggagcgcaccaagagccagggcgagatgggcgtgcggtacgttgtcctcgacatgggtgccatcggtagcatcgacacgagcgggacgagcatgctggacgagctcaacaagtccttggacaggaggggaatgcagatcgtgctggcgaacccgggcagcgagatcatgaagaagctggacagctccaaggtgctggagcagatcggccacgagtgggtgttcccgacggtgggcgaggcggtggcgtcgtgcgactacgtgctgcactcgcacaagccgggaatggccaaggacagcgccgccgcccacgagagcatggtgtgacgagcaccgccacgccaaccgtatgtgtagtgtgctccggttccggtctgacgtaaccagtcgtcacgcggaccgagatgaattatgtatacacgtgtctcgagtattgtacacctgcaccgtcgcgggaaaaacgaattcagagaagaaaggatcccacccggttttttttggtgaaaaaaaaaaaaaaaaaaaaaaaaaaaaaaaaaaaaaaaaaaaaaaaaaaaaaaaaaaaaaaaaa

SEQ ID NO: 220 - protein, 653 aa, Zea mays
MGGSADANGAGSVRVPVPPARPFLDTFRGNLKETFFPDDPFRGVVRERGAGRRTVAALRYFFPFLEWAPAYALSTFKSDLIAGITIASLAIPQGISYAKLANLPPVLGLYSSFVPPLVYALMGSSKDLAVGTVAVASLLISSMLGSEVSPTENPVLYLHLAFTATFFAGVFQASLGLLRLGFIVDLLSHATIVGFMAGAATVVCLQQLKGMLGLVHFTTSTDVVSVMESVFSQTHQWRWESVLLGCGFLFFLLVTRFISKRRPKLFWISAAAPLTSVVLGSVLVYLTHAENHGIEVIGYLKKGLNPPSVTSLQFSPPYMMLALKTGIITGVIALAEGIAVGRSFAMFKNYHIDGNKEMIAIGTMNVLGSLTSCYLTTGPFSRSAVNYNAGCRTAMSNVVMSLAVMVTLLFLTPLFHYTPLVVLSAIIVSAMLGLVDFGAALHLWRVDKVDFCVCAGAYLGVVFGSVEVGLVVAVAVSLLRVLLFVARPRTTVLGNIPGTMVYRRMDQYAAAQTVPGVLVLRVDAPVYFANASYLRERISRWIDDEEERTKSQGEMGVRYVVLDMGAIGSIDTSGTSMLDELNKSLDRRGMQIVLANPGSEIMKKLDSSKVLEQIGHEWVFPTVGEAVASCDYVLHSHKPGMAKDSAAAHESMV

SEQ ID NO: 221 - DNA, 2340 bp, Zea mays
cgccagagcagagagggagagagagaacacacaaggggaggggtggggaagggaagggaagggaggcgcactcgtcccgtctggtatcgtctcccccggcagtgaaggagtagaaggaaggagagtaggagtaggaggggagaatgcgtgtcggcggcgggcgggacgacgacgacgaggtgtcccggaagctcaagagcatggacgtggacaagctggagaacggcggcggggaggagagcccgcggcccgccgtcaagtaccacggctggaaggccatgccgttcatcatcgggaacgagacgttcgagaagctggggacgctgggcacgtcggcgaacctgctggtgtacctgacgcaggtgttccacatgcggagcgtggacgcggcgacgctgctcaacgggctcaacggcaccaccagcctcgcccccatcatcggcgccttcctctccgacgcctacctcggccgctacctcgcgctcgccatcgcctccgtcgcctccctcatcggcatgttcctgctgacgatgacggccggcgcgaatagcctgcacccgccggagtgcagcgtgggcgagacctgcgagaaggcgacgtcgtaccagttcgcggtgctcttcgtggccttcgcgttcctggtgctgggctcggcggggatccgcccctgcagcatgcccttcggcgccgaccagttcgaccccaacacggagtctggcaagcgcggcatcaacagcttcttcaactggtactacttcaccttcacggccgccatgatgatctccgccaccgtcatcatctacgtgcagagcaacgtgagctggcccatcgggctgggcatccccacggcactcatgttcctggcatgcgtgctcttcttcatgggcacgcgcctatacgtgcgggtgacgcccgaggggagccccttcaccagcgtcgtgcaggtgctatcagccgcgctcaagaagcggtcgctgaagcagcccaaggacccgaagcaggacctcttcgacccgccgcacaccagcgccatcgtcaccaagttggcgcacacggaccagttccgctgcctcgacaaggcggccatcgtggcatccccggacgaggtgcgttccggcggcggcgcgcccgcggacccctggaggctctgcagcgtgcagcaggtggaggaggtcaagtgcctcatccgcatcgtgcccgtctggtccacggggatcatctactacgtcgccgtggtgcagcagtccacgtacgtggtgctctcggcgctgcagtccgaccgccacctcggccgcgccggcttccagatccccgccgcgtccttcaccgtcttcgccatgctcgcgcagacgctgtggatccccttctacgaccgcctcctgctgcccaagctccggaagataacgggcaaggaggaggggttcacgctgctccagcgccagggcatcggcatcgcgctctccactgtcgccatggtcatctcggccatcgtcgaggaccggcgccgtgccatcgcgctcagccagccgacgctcggcaccaccatcactggcggggcgatctcggccatgtccagcctgtggatggtgccacagctcatgatcctggggctgtcggaggccttcaacctcatcagccagatcgagttctactacaaggagatcccggagcacatgcgcagcgtggccggggcgctcgccttctgcaacctggcgctcggcaactacctcagcggcttcctggttaccatcgtgcaccggacgacggggtccgggcagaactggctggcgcaggacctcaacaagggccgcctcgacctattctactggaccatcgccggaatcggcgtctttaacttcatctacttcgtcatctgcgccaggtggtacaggttcaagggggccagcaactgatccgccgaggtaaccgtcgtctcacgatcacgacgagtgcgggcatgaatgggactcagctctatgcggtcctgatggcagtttgcttggtggcttgggtaattatgttatggccttggcagagcaacaggaaaaaaaaggggccttaaaataaggtcatgataattattttgtatctaccatagtagttgtttgatatcgacgcctctctctctctctctctctctctctctctctctctgttattactttatatttttgttactgtcctttcatttgaatctataggatggtcaaagtggctgatgaaagaggagaaagaaacaaaacagttggtttcttgttacttgtaagtggttaaactgaaatacaaatggatgtaagattgaatgaaagctttagctcagttaccaaaaaaaaaaaaaaa

SEQ ID NO: 222 - protein, 589 aa, Zea mays
MRVGGGRDDDDEVSRKLKSMDVDKLENGGGEESPRPAVKYHGWKAMPFIIGNETFEKLGTLGTSANLLVYLTQVFHMRSVDAATLLNGLNGTTSLAPIIGAFLSDAYLGRYLALAIASVASLIGMFLLTMTAGANSLHPPECSVGETCEKATSYQFAVLFVAFAFLVLGSAGIRPCSMPFGADQFDPNTESGKRGINSFFNWYYFTFTAAMMISATVIIYVQSNVSWPIGLGIPTALMFLACVLFFMGTRLYVRVTPEGSPFTSVVQVLSAALKKRSLKQPKDPKQDLFDPPHTSAIVTKLAHTDQFRCLDKAAIVASPDEVRSGGGAPADPWRLCSVQQVEEVKCLIRIVPVWSTGIIYYVAVVQQSTYVVLSALQSDRHLGRAGFQIPAASFTVFAMLAQTLWIPFYDRLLLPKLRKITGKEEGFTLLQRQGIGIALSTVAMVISAIVEDRRRAIALSQPTLGTTITGGAISAMSSLWMVPQLMILGLSEAFNLISQIEFYYKEIPEHMRSVAGALAFCNLALGNYLSGFLVTIVHRTTGSGQNWLAQDLNKGRLDLFYWTIAGIGVFNFIYFVICARWYRFKGASN

SEQ ID NO: 223 - DNA, 1259 bp, Zea mays
gtcaaagcgctcgtccctgactggtgactgcgccgagttttattccttgttgccgctccaccacccgctctcgccattgccaccctttttaacccccccttcctctcctccaccaccgctataagtctctcctccgctctcctctctcacctcaaatcccagacgccacgccacccaacacatacaaacacacgcacgcgcgcgcgcgcgcctcccgctgttccgcaaaacaaaggaaacgaaggagaggaggccatggcgccgagaacgtcagagaaaaccatggcaccggcggcggccgctgccacggggctcgcgctcagcgttggcggcggcggcggggccggcggcccgcactacagaggcgtgaggaagcggccgtggggccggtacgcggcggagatccgcgacccggcgaagaagagccgggtgtggctcggcacctacgacacggccgaggacgccgcgcgggcctacgacgccgccgcgcgcgagtaccgcggcgccaaggccaagaccaacttcccttacccctcgtgcgtgcccctctccgcagccggttgccggagcagcaacagcagcaccgtcgagtccttcagcagcgacgcgcaggcgcccatgcaggccatgccgctcccgccgtcgctcgagctggacctgttccaccgcgcggcggccgcggccacgggcacgggcgctgccgccgtacgcttccctttcggcagcatccccgttacgcacccgtactacttcttcgggcaggccgcagccgcagccgcggaagcagggtgccgtgtgctcaagctggcgccggcggtcaccgtggcgcagagcgactccgactgttcgtcggtagtggatctgtcgccgtcgccaccggccgctgtgtcggcgaggaagcccgccgcgttcgatctcgacctgaactgctcaccgccgacggaggcggaagcctagtcgtcgaagcttttaatgactgtctgtcttcttagttctttcttctcctttttctcgaggaaaattcggtactactaagctgagagacgctctcctccgacagacgacgtcgacgacgggcatttttgtaaatagtttttgcgccgggacctttttagtttatgatgaaagctgtattgtcaccgaagacaggtcctgccggcgttgttatggaccggattactatattatattatgcactactagtattttgatagccatgagaaaaaaaaaaaaaaaaaaaaaaaaaaaaaaaaaaaaaa

SEQ ID NO: 224 - protein, 233 aa, Zea mays
MAPRTSEKTMAPAAAAATGLALSVGGGGGAGGPHYRGVRKRPWGRYAAEIRDPAKKSRVWLGTYDTAEDAARAYDAAAREYRGAKAKTNFPYPSCVPLSAAGCRSSNSSTVESFSSDAQAPMQAMPLPPSLELDLFHRAAAAATGTGAAAVRFPFGSIPVTHPYYFFGQAAAAAAEAGCRVLKLAPAVTVAQSDSDCSSVVDLSPSPPAAVSARKPAAFDLDLNCSPPTEAEA

SEQ ID NO: 225 - DNA, 2316 bp, Zea mays
ttgattctaatgggaaagttcgcataactgaatccctgaagaggatcttgtgaattttagtgggaatttgatcgtggaaagtttatgaagttttgttgggattatggatgcataagatagtggtgaatgaagaactatctatgtcagccgtgaacttgggttacattaggagctcagaaatagcacagaactctagaaaatcatttcagcatggcgatcaaagtttgaccgctccagatgatagctgcatgttttttcttggacttgggccaacaccaaatctatattctgctgatagtcactcatttggtggaaacaaagcttatcaatcagcaactttgctcagtcaacattgtgccacaaccgatcctggtttaatgttgggtctttcaagatgtagctcaagaaatttgcaatctacaagggcgagtggcagcaagaattattcacctgcaaggaagactggtatcatcttaccacttattgatgagggatcaacttcagcaaaaaggaaaaaaggtggctatttgctaccacttctgtttgtgccaagatcagaagatctttgtcttaatggaacatctacagacaccgatgcccaacaacatattggaactgaatgtgatactgaaagcggtcataatagatctctgaatcttcacgagattcagcctagcgctgatctatccattacagctggttgttcttttgctgcaacttctgatgtagtagccgatacaagtgatgagcagaggagtcatcagcgccatccaaagaaatgcaggttcaatggttgctcgaaaggtgcaagggatgcatcaggactttgcatttctcatggcggtggccagaggtgccagaagcctggttgcaacaaaggtgctgagagtcgaacggctttctgcaaagctcatggaggagggagacgctgccaggagctaggctgcaccaaaagcgccgaagggaagacagagttctgtattgctcatggtggtgggcgccggtgtgggattgaggaatgcccaagagcggcaagggggaagtctggattctgcataaaacatggtggagggaaaaggtgcaggatagagggctgcactcgtagtgctgaaggccatcctgggttgtgcatctcacatggaggtggtcgccggtgccagtacccaaactgtgataagggggcccaaggaagcaccatcttttgcaagtcccatggtggaggcaagaggtgcatgtttgatggctgtaccagaggagcagagggcagcacgtccttctgcaaagggcatggtggcggtaagaggtgcctctttgagggaggtgggatgtgcccaaagagcgtccatggtggaaccagcttctgtgttgcgcatggagggggcaaacgctgctctgttcccgggtgcaccaagagtgcccgcggtcgctctgattgctgtgtgaagcacggtggtggcaagcgttgcaggttcgatgggtgtgacaagagcgcacaggggagcactgacttctgcaaggctcatggagggggcaagcgatgcgcttggagcaccggctgcgacaagttcgctaggggaaggagtggcctatgcgcagcgcatacgaccctgatggcttccaaggtagtgcaccatcctggacatgcacgaagcatggtcgggccttgccacttcagcggcggcgtctctggttcgtcagcagctgatagcaacatggatcatgccatctcgtcatccggccatggcgcatggtcagactgcgtcgactcgtcgagagacatgcagagcgccggcaggctcctaataccacgtcaggtgcttgtccctggttcactgaaggacgctccttcgtgtggtctagcaggcaacggccaggacgacggagggagccggaaccagagctgtgggctcgtggtgcctgagggaagggttcacggtggagggctgatgtccatgcttggagttggaggcaacctgggaagcaatcctgatggttcgaaagcctgaaataccaaggatgagacgtagaagcacataatttaggttattttgcatgcctctgttatgattcttgcaatggaacatatacatgaatcttcaaatggccattgtgtaactatagtgcttgccaattggccattgtagtatttgctatgtacaagagtggttttggcatctagtcaatgttgtgcatagagctgagaactgcatagttacttgggttcagaaattatgcggaagcttgtaagttgtttcactccgaatttttgcaaacctgtttgctgaaatatttagtccatcctgacgggttcgatcc

SEQ ID NO: 226 - protein, 632 aa, Zea mays
MHKIVVNEELSMSAVNLGYIRSSEIAQNSRKSFQHGDQSLTAPDDSCMFFLGLGPTPNLYSADSHSFGGNKAYQSATLLSQHCATTDPGLMLGLSRCSSRNLQSTRASGSKNYSPARKTGIILPLIDEGSTSAKRKKGGYLLPLLFVPRSEDLCLNGTSTDTDAQQHIGTECDTESGHNRSLNLHEIQPSADLSITAGCSFAATSDVVADTSDEQRSHQRHPKKCRFNGCSKGARDASGLCISHGGGQRCQKPGCNKGAESRTAFCKAHGGGRRCQELGCTKSAEGKTEFCIAHGGGRRCGIEECPRAARGKSGFCIKHGGGKRCRIEGCTRSAEGHPGLCISHGGGRRCQYPNCDKGAQGSTIFCKSHGGGKRCMFDGCTRGAEGSTSFCKGHGGGKRCLFEGGGMCPKSVHGGTSFCVAHGGGKRCSVPGCTKSARGRSDCCVKHGGGKRCRFDGCDKSAQGSTDFCKAHGGGKRCAWSTGCDKFARGRSGLCAAHTTLMASKVVHHPGHARSMVGPCHFSGGVSGSSAADSNMDHAISSSGHGAWSDCVDSSRDMQSAGRLLIPRQVLVPGSLKDAPSCGLAGNGQDDGGSRNQSCGLVVPEGRVHGGGLMSMLGVGGNLGSNPDGSKA

SEQ ID NO: 227 - DNA, 928 bp, Zea mays
cacgctcccaactcgcactcgcccaacctcgaatgccaagctagcaagagaggcctcgatcgcagaacccagcggcaaagcaagcacgcccgtgtctacaggcagctctttccatatggcgcccaagaggagcagcgaggagcgcgcggcggcggagcaggagcagccgaggctccgcggcgtgcggaagcggccgtggggcaggtacgcggcggagatccgggaccccgtgaggaaggcgcgcgtgtggctcggcaccttcgacacgcccgagcaggccgctcgtgcctacgacgccgccgcgcgcaggctccgcgggccgcgcgccaccaccaactaccccggcgacgtcgtccgagaagcgccgtgcacggccccggctctggctgcgagcgcgagcggcagcaccgagtcgtcgtcgtcgtcgtcgtcaagggacgacggccacccgccaccgccgctgcctacggcgccgtcgtcgctcggcctgggcctcgggctcttcccggcgacggtggccacccagccgtgcctgttcctggacccggcgccggtggagagggaggaaggggagcgggagcggagctgctgctcccggtcgccgccgtcggtgctggcgggcctcgggttcgacttcgacctcaacctgcctccgcccgccgagatggtcatgtagcgttggagatagtaattctagcaaaaagggattgtgtagtaaataggaagggcaatcggtttgtgtagtagtagtgtagcactagctagccagtttgcctgtgcactagccactagccaatttgcgacttcgcaatgcaaatcaagaaatcgacgggcaaatatttttctcctgcaaaaaaattgcagtgccatgccatctcctaagactattcacagcggcttcatctaaattttacccctataccacttt

SEQ ID NO: 228 - protein, 186 aa, Zea mays
MAPKRSSEERAAAEQEQPRLRGVRKRPWGRYAAEIRDPVRKARVWLGTFDTPEQAARAYDAAARRLRGPRATTNYPGDVVREAPCTAPALAASASGSTESSSSSSSRDDGHPPPPLPTAPSSLGLGLGLFPATVATQPCLFLDPAPVEREEGERERSCCSRSPPSVLAGLGFDFDLNLPPPAEMVM

SEQ ID NO: 229 - DNA, 1525 bp, Zea mays
caagctcggccttgtaacttgccaccacttttccttccggttccgtgttacgttgtgggcggctgctggcttctgacagcagcgagagcgagagcgagaggccggccggggggcgcgcgccatggacgtggccgtggcgctctccttgctcttctgctgcgtcctcctgctggcctccggcgccatcgccttcctcctcatccgccacttcctggcctccggcgccgaggcgcgagcagcagcgccacgccatcgtcagccaccgccagcggccaaccagcagcagcagcgagcagcgtcaatagccgtcaagaaggaggaggaggaggcgccgcggcggctggcgtggcgggaggtggaggcgctgacaggcgggttcgacgagtccgccgtggtgggccgcggcggctccagcgcagtctacctcgccaggctccttgacggctcgcccgtcgccgtcaaggtgcaccgctggtgcggcggcgagcgccggctgcgcgccttccggcaggagctggacctgctccgccgcctccgacaccccaacatcgtcgcgctcctcgcctactccgacgaccacgaggaagaaggcgcgctggtgctggagtacctcgccggcggcacgctggcggacgcgctccacggcacggcggccgccccgctgccgtgggcgcagcgcatgcgcgccctccacgacgtggcgtgcgcgttggagcacctgcactgcggcggcggcggcggcacctccaccgccgtggtgcacggcgacgtgtcggcgtccaacgtgctcctcttcgacggcggcgcgcggctctgcgacctgggctccgcctgcgagggcttctcggcggccgtggcgccggcgcgcgccgccgtgggatcgccgggctacgccgaccccttcttcctccgcacgggcatcgtgtccaccaagtccgacgtgtacggcttcggcgtactgctgctcgaggccgtcaccggcctgccgccggcgtccgaggcccagaacctgacggcgcggatcctgccgcgggtcagggagcgcggggtggcggggctcgtcgacggcaggctcggggacggcgggctcgacgaggaggaggccgccagcgtggccgagctcgccgtggagtgcctggccgcgcagcccgggctccggccgtcgatggcgcaggtgcgcgccgccatcgcggagaaagcggcgaggtccatcgccaaggcgggttacggccaccatatccagctcagcaagctgctggagctcacatgattccttgcattgtccttgatgtttattagttaggggtacaaaatttaggattgtaagaaaaatggattagtcccgagacactatcctttgcattgtaccatgacctcaaaccatcaagacactatcgcccctcaatgattgagtgatcctgtgtagcaggcagaggcaggggagtgcttgtcattcaggttgtggccgaaagcttttggaggaccagacacctcatattatgattgttgaaaagaaagatctgct

SEQ ID NO: 230 - protein, 382 aa, Zea mays
MDVAVALSLLFCCVLLLASGAIAFLLIRHFLASGAEARAAAPRHRQPPPAANQQQQRAASIAVKKEEEEAPRRLAWREVEALTGGFDESAVVGRGGSSAVYLARLLDGSPVAVKVHRWCGGERRLRAFRQELDLLRRLRHPNIVALLAYSDDHEEEGALVLEYLAGGTLADALHGTAAAPLPWAQRMRALHDVACALEHLHCGGGGGTSTAVVHGDVSASNVLLFDGGARLCDLGSACEGFSAAVAPARAAVGSPGYADPFFLRTGIVSTKSDVYGFGVLLLEAVTGLPPASEAQNLTARILPRVRERGVAGLVDGRLGDGGLDEEEAASVAELAVECLAAQPGLRPSMAQVRAAIAEKAARSIAKAGYGHHIQLSKLLELT

SEQ ID NO: 231 - DNA, 3164 bp, Zea mays
ctccaaccatgtccaccaacacactgatctagtactaggactagtactagatcgatcctgcctgcctgcctgcttgtaacagcaacagcagcagaagtggcgcactgtgctttgcggtggcggaggctgcgagagaggaggaacttgcaagccgacttccatggctgccgccttctccgccgctatcctcttccacctgctgctgctcctcttctcgccgtccgctgcgcagcctggtttcattagcttggactgcgggggagctcgtgatcacacggatgccattgggatccagtggacctctgatgccagcttcgtctctggcggccaggccgcgcagctgctggtccagaatggcctgcagcagacccagcagcagctgaccaccgtgcgctacttccccgcggacaacaggaagcactgctacaccatgaacgtcaggaacaggacgcgctaccttgtcagggccactttcctctacggcaacttcgataacagcaacgtctacccgaagttcgatatctccctcggagcgtctccctggtccaccatcgtcgtcgacgacgccaccacccccgtcgttgaggaagccatcatcttggctgctgctcccacgctcagtgtatgtctctccaatgccagcacgggacagccctttatctctactctggagcttcgacagtttaacggttcgctctactacaccactgacgagacacgcttctttcttggactgtctgcgaggataaattttggcgcaggaagcaatgattcagtgagatatcctgatgatccatttgatagaatctgggaatctgattctgtgaggagagcaaattaccttgttgatgttgctccagggactgaaagaatatcaactacaaaacccatatttgtcggtaccaacgaagaaccacctgaaaaggtcatgcaaacagcagtagttggccaggatgggtcattgaactaccgccttgatttggaaggtttcccagcaaatgcttggggagtctcgtattttgcagaaattgaagatttggcaccaaatgaaacgaggaaatttaagttagaggtccctggcatgccagcactcagtaaaccaactgttgatgtggaggagaatgctcaagggaaataccgtttgtatgaaccaggctacacgaatttgtcacttccgtttgttttctcctttgggttcaggaagacgaatgattcttcaaaggggcctattttgaatgccctggagatttacaaatatgtccaaattactatgggatcacaggatgcaaatatcatggccagcatggtatcacgatatccacaggaaggttgggcacaagagggtggtgatccgtgcttaccagcatcatggtcctgggtgcaatgcagttcagaaacttctccaaggatattctcaatcacattgtctgggaagaacattaccggaagtatcccggtggaactgacaaagctatcagggttggttgagctaaggcttgatggtaattcattttctggccaaattcctgatttcagagaatgtgggaatttgcagtatattcaccttgagaacaatcagttaactggtgaattgccatcttctttgggtgacctacctaacctgaaagagttgtatgttcaaaataacaagctgtctgggcaggttccaaaagcacttttcaagagaagcattattttgaacttctcaggtaacagtggccttcacatagtaagcaatggcattagccacaccataattgttatatgtctggtgattggagccgttgtcttactgggtgttgctattgggtgctatttcattacatgtaggagaaagaagaaatctcatgaaggtacaccttttagctcaatcgacatatctgatactatgctagagcatgcagtgattcttttgccatctccagacactgttgtcattgcagcagcaccagctaaaaaacttggttcatattttagtgaagtggctacagaatcagcacacagattttctttatctgaaattgaaaatgctactggcaaatttgagagaagaattgggtctggaggctttggcatagtatactatggaaagttggctgatgggagagagattgcagtcaaacttctcacgaatgactcgtatcagggaatcagagaattcttgaatgaggtgacattgctttccagaatacatcatagacacctggttacattccttggttacagtcagcaagatggcaaaaacatactagtgtatgagttcatgcataatgggacactaaaagagcaccttcgtggagctgataatgaaaagataactagctggctgaagcgtcttgagattgcagaagattctgcgaaaggtatagagtatctccacacgggatgctccccaacaatcatccatagagacctgaagagcagtaacattctcctagacaagaacatgagagcaaaagtggcagactttgggctttcgaaacctgcagtggatgggtctcatgtgtcaagtatagttcgagggacagttggatacctggacccagagtactacatctcgcagcagctgacggagaagagcgacatctacagcttcggcgtgattttgctggagctcatctctgggcatgaacccatctcgaatgacaactttgggctcaactgccggaacattgttgcgtgggcccgatcgcacatcgagagcgggaacatccacgccatcattgatgagtcgttggacagaggctgctatgacctgcagtcggtgtggaagatcgcggaggtggccataatgtgtgtgaagcccaagggcgcccagaggcctcccatctcggaagtgctcaaggagatccaggacgccattgccatggagcgggtgctcgtgtccaattgcagcaacaggatgggttcaggtagcgtggagcagaatggaggagcatctttcgacgagctgctcatgcagccgggtctcagatgagatgagaacaacctactcgtaccttgagtccattgtatgtagtaattaatgtgtttactacattttttttgagaaacaaattaagtaatgctagcaaaggaaccagtatattattattattattattattattattattattattattattattattatggttattattaaaaatattattattaaa

SEQ ID NO: 232 - protein, 938 aa, Zea mays
MAAAFSAAILFHLLLLLFSPSAAQPGFISLDCGGARDHTDAIGIQWTSDASFVSGGQAAQLLVQNGLQQTQQQLTTVRYFPADNRKHCYTMNVRNRTRYLVRATFLYGNFDNSNVYPKFDISLGASPWSTIVVDDATTPVVEEAIILAAAPTLSVCLSNASTGQPFISTLELRQFNGSLYYTTDETRFFLGLSARINFGAGSNDSVRYPDDPFDRIWESDSVRRANYLVDVAPGTERISTTKPIFVGTNEEPPEKVMQTAVVGQDGSLNYRLDLEGFPANAWGVSYFAEIEDLAPNETRKFKLEVPGMPALSKPTVDVEENAQGKYRLYEPGYTNLSLPFVFSFGFRKTNDSSKGPILNALEIYKYVQITMGSQDANIMASMVSRYPQEGWAQEGGDPCLPASWSWVQCSSETSPRIFSITLSGKNITGSIPVELTKLSGLVELRLDGNSFSGQIPDFRECGNLQYIHLENNQLTGELPSSLGDLPNLKELYVQNNKLSGQVPKALFKRSIILNFSGNSGLHIVSNGISHTIIVICLVIGAVVLLGVAIGCYFITCRRKKKSHEGTPFSSIDISDTMLEHAVILLPSPDTVVIAAAPAKKLGSYFSEVATESAHRFSLSEIENATGKFERRIGSGGFGIVYYGKLADGREIAVKLLTNDSYQGIREFLNEVTLLSRIHHRHLVTFLGYSQQDGKNILVYEFMHNGTLKEHLRGADNEKITSWLKRLEIAEDSAKGIEYLHTGCSPTIIHRDLKSSNILLDKNMRAKVADFGLSKPAVDGSHVSSIVRGTVGYLDPEYYISQQLTEKSDIYSFGVILLELISGHEPISNDNFGLNCRNIVAWARSHIESGNIHAIIDESLDRGCYDLQSVWKIAEVAIMCVKPKGAQRPPISEVLKEIQDAIAMERVLVSNCSNRMGSGSVEQNGGASFDELLMQPGLR

SEQ ID NO: 233 - DNA, 1944 bp, Zea mays
tcctccacctccctccattttgccgccgctgccgctccagcaccagcctgctccggcgcagcacctcagcccaggcgcccatcgcttcgccagtctcatacggccatggaccgcggcggccacgcggcgctgctgctgctgctgctggcgctggcggtgatccccgtgacgggcgccgccggcgcggcgttcctggaggaggacgcgatcctgggcgccgtggagcgcgcgatgatgcgcggcggcggggggaagggcgccgcgaccgcgaacgcgagcgggaggcaccagcaccggcgccagcgctacggcgtgggggcgccgtggagggaggagatcgcggggctggcggggcggcccgagctggcggcgtggctgcgctcggtgcggcgccggatccacgagcgccccgagctggcgtacgaggaggtggagaccagccgcctggtccgcgacgagctgggcgcgctgggcgtcgggttccgccaccccgtcgcgcgcaccggcgtcgtcgccacgctcggcaccggccgcccgcccgtcgtcgcgctccgggccgacatggacgcgctgcccatccaggaggccgtggagtgggagcacaggagccgggtccccgggaagatgcacgcgtgcggccacgacgcgcatgtggccatgctgctcggcgccgccagcatcctcaaggctcgcgagcaccaactcaagggcacggtgaagcttctgttccagccggcggaggagtcgggctgcggcgcgaagcggatgatcgaggacggcgcgctggagggcgtggaggccatcttcgccgtgcacgtgtcgcaccagcacccgacgtccgtggtcgggtccaggacgggggccctcctcgccggctgcggcttcttcaaggccgtgatacgcggcggcggcggcggcggcgaccgggcgtccgaccccgtcgtcctggccgccgcctccaccgtcatcagcctgcagggcatcgtctcccgcgaggcggacccgctggactcgcaggtggtgtcggtggcggtggtgaacggcggcagcgagcaggcccagcctcaggagcaggagctggtgctgggcggcacgttccgcgccttctccaacgccagcttctaccagctgcggcggcggatcgaggaggtggtcacggcgcaggcgcgcgtgcacgggtgcgccgcgtccgtcgacttcttcgagggccagagcttctacccgccaacggtgaacgacgcgcgcatgtacgcccacgtgcggcgcgtggcgaccgacctcctgggcgcgcaggcgtaccgcgacgtgccgcccatgatgggcgccgaggacttctccttctactcgcaggccgtgcccgccgggttctactacatcggggtgcgcaacgagacgctgggatccgtgcacacgggccactccccctacttcatgatcgacgaggacgtgctccccaccggcgcagccgtgcacgccgccatcgccgagaggttcctcgccgaacacgactccatcatgggcgtggccgcctccgacgaccaggacccctaggccgagcgcggtgggaaccgcgtggggagtttggccccgtcgctcggtcggcacggcagggatggtggcggaatgcgggctcgggctgctttttagattttgtggccgatgggctcttggtgggccgacctgtccgcgggctgacgtgcccacggttcaggttttttttccctccgtgttccgtttgggcgagcaaggaaaggaaccatgctgtgctggtgcagtgatgctgatgcaaatagtaggctgctctacgtatgtgtttttgtccctttttgggatgtcctgaaaactcatgatgtatagcacggtagctcctgcctacttggtagcaggacctctctggctgccacgcatgtttatgcactttcctctttattattatatcaatct

SEQ ID NO: 234 - protein, 481 aa, Zea mays
MDRGGHAALLLLLLALAVIPVTGAAGAAFLEEDAILGAVERAMMRGGGGKGAATANASGRHQHRRQRYGVGAPWREEIAGLAGRPELAAWLRSVRRRIHERPELAYEEVETSRLVRDELGALGVGFRHPVARTGVVATLGTGRPPVVALRADMDALPIQEAVEWEHRSRVPGKMHACGHDAHVAMLLGAASILKAREHQLKGTVKLLFQPAEESGCGAKRMIEDGALEGVEAIFAVHVSHQHPTSVVGSRTGALLAGCGFFKAVIRGGGGGGDRASDPVVLAAASTVISLQGIVSREADPLDSQVVSVAVVNGGSEQAQPQEQELVLGGTFRAFSNASFYQLRRRIEEVVTAQARVHGCAASVDFFEGQSFYPPTVNDARMYAHVRRVATDLLGAQAYRDVPPMMGAEDFSFYSQAVPAGFYYIGVRNETLGSVHTGHSPYFMIDEDVLPTGAAVHAAIAERFLAEHDSIMGVAASDDQDP

SEQ ID NO: 235 - DNA, 1578 bp, Zea mays
gctcacgctcaggtcgccgtcgcgactcgcgccgcctctcggctcgctagccgctacgctatctacgccgccccggcacctcccatgagatgagagccgcagccgcagccacatccacagccgccgcgctcctcgcccccggtctaaagctctgcgcgggcggcgcccgcgcgcgcgtctcctgtccctcccgctcccgcctcccactccaccgcatcgccgccatggcctccgcccccaacccctccttccgcccggaggaggcacgctcccctcccgccctcgagctcccgaccccgccgctctccaagttcaaggtggcgctgtgccagctctcggtgacggcggacaagaatcgcaacatcgcgcacgcgcgcgcggccatcgagaaggcggcctccgagggcgctaagctcgtccttctcccagagatatggaatggtccgtattcaaatgacagctttccagagtacgcggaggacattgaagctggcggagatgcggccccttcattttcaatgatgtcggaggttgctcgcatcttacaagtcactcttgttggtgggtccatagctgaacgttcgggaaacaacttatacaatacatgctgcatctttggttcagatggcaaacttaagggtaaacatagaaagatccatctttttgacattgacattccaggaaagatcactttcaaggaatcgaagactcttactgctgggcagaatcctactgttgtagacacagatgttgggcgaattggtattggtatatgttatgacatccgtttccaggaattagcaatgttgtatgctgcaagaggtgctcatttgttatgctatcctggtgcattcaatatgactactggaccactgcattgggagttgctgcaaagggcaagggctacagacaaccagctgtttgttgcaacatgcggcccagctcgagataccagtgcaggatatgttgcttggggacactccactcttgttggaccttttggagaggtgattgcaacaactgagcatgaggaggcaactataatagcagaaattgactactcactgattgagcagaggaggcaatttcttcctctgcaacaccaacgccgtggcgatctctatcagctggttgatgtccagaggctgggttctcattagcacagggacgaagcaggagagcagttgactctgcaggcttgctcgtactacttcgttcatgagatgcatgcccatgcccatcgagagatcgatcaacttgatgtgtgaaggtggagaggacggaataaagcgactatagtttgtaccttcagcgctagtttggcaactctattttacaagagattcttatttttctaaggaaaaattgattaatttttcttaggaaaatagaaatcacttgggaaaatatgattgccagactagccctcagtgtaaatgtctccatgtcaagggcggtattgcccaaggtaggaggacctcggctacgtagatcgtagccttgacccgtggttgccggcagggttatgcccccacgccgagctacccgtcgacaggagaagttctcctggtcgccggt

SEQ ID NO: 236 - protein, 356 aa, Zea mays
MRAAAAATSTAAALLAPGLKLCAGGARARVSCPSRSRLPLHRIAAMASAPNPSFRPEEARSPPALELPTPPLSKFKVALCQLSVTADKNRNIAHARAAIEKAASEGAKLVLLPEIWNGPYSNDSFPEYAEDIEAGGDAAPSFSMMSEVARILQVTLVGGSIAERSGNNLYNTCCIFGSDGKLKGKHRKIHLFDIDIPGKITFKESKTLTAGQNPTVVDTDVGRIGIGICYDIRFQELAMLYAARGAHLLCYPGAFNMTTGPLHWELLQRARATDNQLFVATCGPARDTSAGYVAWGHSTLVGPFGEVIATTEHEEATIIAEIDYSLIEQRRQFLPLQHQRRGDLYQLVDVQRLGSH

SEQ ID NO: 237 - DNA, 1318 bp, Zea mays
caatcccacaccaccaccacctcctccggtccccaacccctgtcgcaccgcagccgccggccatggcctgcctcaccgacctcgtcaacctcaacctctcggacaccaccgagaagatcatcgcggaatacatatggatcggtggatctggcatggatctcaggagcaaagcaaggaccctctccggcccggtgaccgatcccagcaagctgcccaagtggaactacgacggctccagcacgggccaggcccccggcgaggacagcgaggtcatcctgtacccgcaggccatcttcaaggacccattcaggaggggcaacaacatccttgtgatgtgcgattgctacaccccagccggcgagccaatccccaccaacaagaggtacaacgccgccaagatcttcagcagccctgaggtcgccgccgaggagccgtggtatggtattgagcaggagtacaccctcctccagaaggacaccaactggccccttgggtggcccatcggtggcttccccggccctcagggtccttactactgtggaatcggcgccgaaaagtcgttcggccgcgacatcgtggacgcccactacaaggcctgcttgtatgcgggcatcaacatcagtggcatcaacggggaggtgatgccagggcagtgggagttccaagtcgggccttccgtgggtatttcttcaggcgaccaggtctgggtcgctcgctacattcttgagaggatcacggagatcgccggtgtggtggtgacgttcgacccgaagccgatcccgggcgactggaacggcgccggcgcgcacaccaactacagcacggagtcgatgaggaaggagggcgggtacgaggtgatcaaggcggccatcgagaagctgaagctgcggcacagggagcacatcgcggcctacggcgagggcaacgagcgccggctcaccggcaggcacgagaccgccgacatcaacacgttcagctggggcgtggccaaccgcggcgcgtcggtgcgcgtgggccgggagacggagcagaacggcaagggctacttcgaggaccgccgcccggcgtccaacatggacccctacgtggtcacctccatgatcgccgagaccaccatcatctggaagccctgagcgccgcggccgttgcgttgcagggtccccgaagcgattgcaaagccattgttccttccgttctgtttgcttattattgttattatctagctagatcatctgggggtcaggtcgtcgtggtgtgccaaaacagaacacagaaagaggaagaagaaaaaaaaaacaagacgtgtggcgtttatgtt

SEQ ID NO: 238 - protein, 356 aa, Zea mays
MACLTDLVNLNLSDTTEKIIAEYIWIGGSGMDLRSKARTLSGPVTDPSKLPKWNYDGSSTGQAPGEDSEVILYPQAIFKDPFRRGNNILVMCDCYTPAGEPIPTNKRYNAAKIFSSPEVAAEEPWYGIEQEYTLLQKDTNWPLGWPIGGFPGPQGPYYCGIGAEKSFGRDIVDAHYKACLYAGINISGINGEVMPGQWEFQVGPSVGISSGDQVWVARYILERITEIAGVVVTFDPKPIPGDWNGAGAHTNYSTESMRKEGGYEVIKAAIEKLKLRHREHIAAYGEGNERRLTGRHETADINTFSWGVANRGASVRVGRETEQNGKGYFEDRRPASNMDPYVVTSMIAETTIIWKP

SEQ ID NO: 239 - DNA, 1406 bp, Zea mays
ttcgctctctctctctctctctctctctcgtgttcttctcgtcttctgcccgagtgatggccagcctcaccgacctcgtcaacctcgacctgagtgactgcaccgacaggatcatcgccgagtacatctggattggaggaaccggcatagacctcaggagcaaagcgaggacggtgaaaggccccatcaccgacccgagccagctgccgaaatggaactacgacggctccagcaccgggcaagctcccggagaggacagcgaagtcatcctctaccctcaagccattttcaaggacccgttcaggaagggtaaccacatccttgtgatgtgtgactgctacacgccacaaggcgagccaatccccaccaacaagaggtacagcgccgccaaggttttcagccaccccgacgtcgcagctgaggtgccgtggtacggtattgagcaggagtacaccctccttcagaaggacgtgagctggcccctcggctggcctgttggtggataccctggtccccagggaccatactactgcgccgccggtgccgacaaggcctttgggcgcgacgtggttgacgcccactacaaggcctgcctctacgccggcatcaacatcagcggcatcaacggcgaagtcatgcctggacagtgggagttccaagtggggccgtccgttgggatctctgccggcgacgagatatgggtcgcccgctacattctcgagaggatcaccgagatggccggaatcgtcctctccctcgacccgaagccgatcaagggcgactggaacggcgccggcgcccacaccaactacagcaccaagtcgatgagggaggccgggggatacgaggtgatcaaggcggcgatcgacaagctggggaagaggcacaaggagcacatcgccgcgtacggcgagggcaacgagcgccgcctcacgggccgccacgagaccgccgacatcaacaccttcaaatggggcgtggcgaaccgcggcgcatccatccgcgtcggccgcgacaccgagagggagggcaagggctacttcgaggaccgcaggccggcgtccaacatggacccctacgtcgtcaccggcatgatcgccgagaccaccatcctgtggaatggaaactgatcaagcatgtgcattctcgagggagcccactgtttttcttctgcacaacgcatccgccgtggtgtcgctttggttttgaaatttagattccgttgtcctaaaatttatcactacggtctccagtgtattgctcgggaacgaatgaataacgactgcgatgtttgtttttttttttgctggcgtagtagatgtacgtttggctgtgcttccagtttattgggtaaatgaaaaaatgtaatggtctaccggtcttaaaatagtagtcattttagctct

SEQ ID NO: 240 - protein, 357 aa, Zea mays
MASLTDLVNLDLSDCTDRIIAEYIWIGGTGIDLRSKARTVKGPITDPSQLPKWNYDGSSTGQAPGEDSEVILYPQAIFKDPFRKGNHILVMCDCYTPQGEPIPTNKRYSAAKVFSHPDVAAEVPWYGIEQEYTLLQKDVSWPLGWPVGGYPGPQGPYYCAAGADKAFGRDVVDAHYKACLYAGINISGINGEVMPGQWEFQVGPSVGISAGDEIWVARYILERITEMAGIVLSLDPKPIKGDWNGAGAHTNYSTKSMREAGGYEVIKAAIDKLGKRHKEHIAAYGEGNERRLTGRHETADINTFKWGVANRGASIRVGRDTEREGKGYFEDRRPASNMDPYVVTGMIAETTILWNGN

SEQ ID NO: 241 - DNA, 937 bp, Zea mays
gatgcatgcacagctcagcgcacccgatgctctctgcccacgcatcttggcaccccggacccccgcccgctccccgcctttataagcggcagcagccacggcaggtggagctcatcgcatccatccaccacgcaccccaccaacccatacccataccagaggctctctgattttacttctccgcggtagatcggctgagcgagcgagcgaggcacacggagctagctaaacagagcacacgggtagaaaagcaagatgtcggacggcacggcgacctgcatcgacatcatcctcgccatcatcctgccgccgctcggggtcttcttcaagttcggctgcggggttgagttctggatctgccttatcctcaccttcctcggctacctccccggcatcatctacgccgtctgggccatcaccaagtagccggccggagcagatgaaccacggtcccctgccagtgccaggcagctagctgtgactccgtcgcgtgcgttagcatgcaatgcaagcgcagggtggtctcgtggggggacgtggtgtgcgcgtgtcttgagatgtgattccttccttctttgtttagttgctgctgctcctgctggtgtagtactggtgtatccagtccttttaatttcttgattagtttgctcggctgaagaaatcaggacgcgtgcctggtgtcgctcctcagctccatgtacttgtacaaccgttcctccctgcagctgctgccccttctctcttttttgtttaccttgggttgatgggttgttaaattcgttgtttgtctcttttttaaccttcgcgattgtagtactgggttggttgcttgcttggttggtttcggttgggagatcgatgggaataagtctatgatatatatcagtacaacaaaagagagaaagaaattgccgccgtcaaaaaaaaaaaaaaaaaa

SEQ ID NO: 242 - protein, 56 aa, Zea mays
MSDGTATCIDIILAIILPPLGVFFKFGCGVEFWICLILTFLGYLPGIIYAVWAITK

SEQ ID NO: 243 - DNA, 1671 bp, Zea mays
atggggtcatcaaggaatgtgccgcacaaagtgatgcaagatgagatcacacctcttctcccgatcaaagctgaggaggatgcagttcatgagttcgacggagcttctttctctggcgcggtcttcaatctgtcaacaaccattgtaggagctggaatcatggctctgcctgcgagtatcaagatgctaggccttatacctggtattctaatgatcatccttgtggcactgctcaccgagacatccattgacatgctggtcaggtgcagccaccagggcaagattacatcctacggctggttgatgggtgacacatttggtcagtgggggagaattgcgctacaagcatcggtggtgataaacaatgtcggcgtgttgattgtatacatgattattattggtgatgtcctatcaggaacatcgtcaacaggtgttcatcacagtggcgtattggaggggtggtttggacctcatatgtggaattctcgtcccattgtactcctcgctacaactcttcttgtgtttgctccattggtgagctttaaacgtttggattcattgagatacacatctgcactatcagttgctcttgctgtggtttttgttgtcatcactgccggggttgctattgtcagactcatccaaggaactgtggagatccccaaactgtttcctgagatagatggagttagttctgtctggaaactgttcacagctgtgcctgttcttgtcactgcctacatctgccactacaatgttcacagcatcgataatgagctggaggacaaaactcagattaaaccaattgtgcaaacttctctgggactctgctcaagtgtttacattgcaacaagcttcttcgcatatctcctctttggcgaggctaccttggctgatgtgcttgccaatttcgactctgaccttcgcattccgttgagttctgccttcaatgacatagtgagagtgagctatgtcgtccatatcatgcttgtcttccctattgtattctttgcccttaggctcaacttggatggattactctttcccaccgcaaggcacatttccggtgacaacaagaggttcaccattatcaccatctcacttattgctgtaatttatcttgctaccatcttcataccaagcatctgggatgctttccaattcactggcgccacagctgctgtgcttatcggtttcatctttcctgccatgattatactaagggacccatatggtgtttcaaccaagcgtgacaaggttttggcggtaacaatgattgtgcttgctgtggtgtccaattgtgtggccctgtacagtgatgcgttcaacatcttctacaggaagcaggaggcctagagcccatacctcaggggaagagaacctctttgtacaggtcaagggtgattgttgagcttcaagtaagctactactgagcagcagtaccacgaatctcatggtggtcaatagtttttgtttggtcacttcgaagaaactttggtttgctgcgaatatttgtctagtttcctgaacataaactgcctccacatctggatgggaccacgtgtgctatgatcacccgtggaacaatttttttcttgtaatggatgattgaaatagctgtatataaatatataataatatgcaaaaaaaaaaaaaaaaaaaaaaaaaaaa

SEQ ID NO: 244 - protein, 472 aa, Zea mays
MGSSRNVPHKVMQDEITPLLPIKAEEDAVHEFDGASFSGAVFNLSTTIVGAGIMALPASIATGKMLGLIPGILMIILVALLTETSIDMLVRCSHQGKITSYGWLMGDTFGQWGRIALQASVVIATGNNVGVLIVYMIIIGDVLSGTSSTGVHHSGVLEGWFGPHMWNSRPIVLLATTLLVFAPLVSATGFKRLDSLRYTSALSVALAVVFVVITAGVAIVRLIQGTVEIPKLFPEIDGVSSVWKLFTAVATGPVLVTAYICHYNVHSIDNELEDKTQIKPIVQTSLGLCSSVYIATSFFAYLLFGEATLADVATGLANFDSDLRIPLSSAFNDIVRVSYVVHIMLVFPIVFFALRLNLDGLLFPTARHISGDNKRATGFTIITISLIAVIYLATIFIPSIWDAFQFTGATAAVLIGFIFPAMIILRDPYGVSTKRDKVATGLAVTMIVLAVVSNCVALYSDAFNIFYRKQEA

SEQ ID NO: 245 - DNA, 1907 bp, Zea mays
atggagcgggcggaggaggcgcagcccgccgccgagcggagggcgccctcgacggcgccgtcggcgcgggtgtcgatctgggagtcggtacgcgcgtgcggggtgtgggggaaggagctggacaaggccgagctgcggaggcaggtcgtcatgccacgctacctgcgccgggccgtcgcggccgccgtcaaggccaaggacgaggccgccggcgtggcggtggcggcggcggccgcggaggaccgcgcgggggaggacgccgacggcccggcggtggcgcccgtggtggtgttcgtcaactcgcgcagcggcgggcgccacgggcccgagctcaaggtgcggctgcacgagctcatcaccgaggagcaggtctttgatctttccgttgtgaagccttcagattttgttcaccatggtttgagttgtttggagaggttagctgaccaaggcgataaccgtgcgaaggctgttcgtgagaaaatgaggattgtggttgctgggggtgatggtacagttggttgggtgcttggatgtctctcagatctttataagatgaaaagggaaccggttccacctacaggaatcattccacttggtacaggaaatgatcttgctagatcgtttggatggggtggctcttttccctttggttggcgctcagctgtaaagcgttatctcagcaaagcttccagatctcccatttgccgtcttgacagctggcaaactgtaattcagatgccagaaggagaaatagaagagttgccatatgcacttaagaaagtagaacctgtagaccggttggagatcagccaggagaacggtacagagttatccgaaaaggcttctttctataaaggagtattctacaactaccttagcattgggatggatgctcaggttgcatatggcttccatcatcttcgtgatgaaaagccatatcttgcacaaggaccagttgcaaataagttgatttatgctggatatagctgcactcaggggtggttttgtacaccttgcacagcgagtccacagctaagggggcttaagaacattttgcgaccttccattaaaaaagccaattgttcaaagtgggagcaagtgaaaatgccttcaagcgttagatccctggttgtgttaaatttaaccatttctggcagtggaagccatccatggggtgatctaagacctgagtatctcaaaaagaaaggctttgttgaagcccattcacaagatggcttgcttgaaatatttggtctgaaggaaggttggcatgcttcatttgtcatggccgagcttatcaaagcaaagcacattgcccaggctgcggctatcaagttcgaaatgaggggtggcgagtggaaccgagcatatgttcagatggacggagagccgtggaaacaaccgctgctacaggagcactcaaccatcgtggaaataaacaaagttccgtatcattctctcatgataaacggggagtaatgagatttttactccgtcaaccagggttgcattcatagatcgttaggatcgtgtacagttcaggagcagcgggcactagatccttagaactgggtcggacggactgcagcgaggatggcatgcatgttcgttggccttttgtcgtgctatggtcgaagccatggccggagcgtgatgtggcaccatgcattgttgtattcgtaccataatatgtgcgttgttgtatcctaagttctttttgaaggaaacatgattgatttgtttgtattgtaacgttgtgtcattgcaaaagaataacctggtgtaaaactgtaaaatgtgacagtctgccgtttgcacagccctgtagcattttttttttgttaaaaaaaaaaaaaaaaaaaaaaaaaaaaaaaaaaaaaaaaaaaaaaaaaaaaaaaaaaaaaaaa

SEQ ID NO: 246 - protein, 492 aa, Zea mays
MERAEEAQPAAERRAPSTAPSARVSIWESVRACGVWGKELDKAELRRQVVMPRYLRRAVAAAVKAKDEAAGVAVAAAAAEDRAGEDADGPAVAPVVVFVNSRSGGRHGPELKVRLHELITEEQVFDLSVVKPSDFVHHGLSCLERLADQGDNRAKAVREKMRIVVAGGDGTVGWVLGCLSDLYKMKREPVPPTGIIPLGTGNDLARSFGWGGSFPFGWRSAVKRYLSKASRSPICRLDSWQTVIQMPEGEIEELPYALKKVEPVDRLEISQENGTELSEKASFYKGVFYNYLSIGMDAQVAYGFHHLRDEKPYLAQGPVANKLIYAGYSCTQGWFCTPCTASPQLRGLKNILRPSIKKANCSKWEQVKMPSSVRSLVVLNLTISGSGSHPWGDLRPEYLKKKGFVEAHSQDGLLEIFGLKEGWHASFVMAELIKAKHIAQAAAIKFEMRGGEWNRAYVQMDGEPWKQPLLQEHSTIVEINKVPYHSLMINGE

SEQ ID NO: 247 - DNA, 2021 bp, Zea mays; identical to SEQ ID NO: 21

SEQ ID NO: 248 - protein, 597 aa, Zea mays; identical to SEQ ID NO: 22

SEQ ID NO: 249 - DNA, 2831 bp, Zea mays
atggcgccagcccagcatcaagcagcagctgacagaggcagcagggaagagatcgtcatcgtggacctcgagagcgaggccggcgccgacgacgcggcggcggcggcggcgacgatgcagcggcaggactcgctgtacgcggccgcaacaagagccgccggcgccaaccaccacggacaggacagctgggccaggacgctgcggctggcgttccagtgcgtggggatcctgtacggcgacattggcacgtcgccgctgttcgtgtactcgagcacgttccgggacggcgtcggccacccggacgacctgctcggcgcgctctccctcatcatctacagcttcctgctcttcaccgtcatcaagtacgtctacatcgccctgcgagccaacgacgacggtgacggtggcactttcgccctctacactctcatctcgcgccacgccaaggtgagcctgatcccgaaccagcaggtggaggaggacgacctcgtcgccaagtacaaccgcgacaagccgccggcgacgctccggcgagcggaatggatgaaggagctgctcgagacgaacaaggccgtcaaggtctcgctcttcctcatcaccatgctcgccaccgccatggtcatcagcgacgctatcctcacccctgcaatctcagtcctctccgccgttggcggtctcaaagagaaggcgacttttctcaccacagacgagatagtctggatcaccgtggggattctggtggcgctgttcgcgatccagaggttcgggacggacaaggtcggctacctgttcgcgccgatcatcctgctctggctgctcctgttcgcggccgtcggcttctacaacctggtgaagtacgacaccggcgctctcagggcgttcaacatgaagtacatcatcgactacttcagacggaacaagaagaaagggtgggcctcccttggaggcatactcctttgcttcacaggcacagaagccctttttgctgatctaggctacttcagcatcaggtcgatccagctgagctttggcttcggtttagtcccctcagtgctgctcgcttacatcgggcaagcagcgtacttgagagtgcacccggaggatgtggccaacactttctacagatccactccaatctccttgttctggccaacgttcattctcgcgctagcagcatcgatcattgggagccaagccatgatctcctgcgccttcgcgacaatctcgcattcccagacactcggttgctttccgagggtaaagatactgcacacctcgaggcaatactcgggccaactatacatccctgaagtaaactacctgctgtgcttgggtgcttgcctcgtcacagttggcttcaggacaactgtcatcattggggaagctcatggtatatgcgttgttcttgtgatgatcgtcacaaccctgttgctgacgatcgtgatgctcctagtatggaagatcagcgtctggtggatcgtcgcgttcttccttgttttcatgtcgtccgagtcgatctatctatctgccatcctgtcccgattcgcgcacggcgcgtacgtgcccgtggcaatgtcggcggtcctgatggtggtgatggtcgtgtggcactacgtgcacgtgaacaagtacaggtttgagctcgagcactctatcccccgcgacaaagtgaaagagctccttgagcgcagcgacatacagagggtgccagggatcggcctcttctacaccgagctggttcagggcatacccccggtgttccgtcatctcatcgagaagatcccttccatccactcggtgctcattttcgtctccatgaagcacctgcccatcccatctgtcgacatgtcggagcgctttctctttagacaggtagacagagaagattacaaggtgttccagtgcgtggcacggtatgggtacagggaccccttcgaggaggccaaggacttcgttgacaaacttgtagagcatctccagtactacatccgggatgtcaacctctatggcctgggctgcgagccgatgatgaagcagtccttcagctactgcagttctcgcgctgagagctttggcagccatgaaaaaaccaaagtaaaggcagtctacgctgaggagatgctcacaccagcagagtcattctcggagcacgcgaggcaagctagtgaaaagaccaagctttttacccaatttcagggagacaagatgaatatagtagagatgatgaagattcagcaggagcaacaggctgtccttgaagagatgagtaaaggtgtagtgtacatacttggagagaccgaggtggtggcgaggcctcaatcctcgctcattaagaagattgcggtcaactacatatactccttcctgaggaagaacttcatgcaaggggagaagatgctgtcgattccgcatggcaagctactgaaagttggaatctcgtatgagatctagagatcacgtaacggcgtttcatatggatgtatggcaacaagcacatgcacacaacatagctgggatctggacatgtttccgcatggattatttgtaaaatagtttgtacaatgatgtaacgtgcgaggtatatatagttaacaaccaggatgctatgatgctgcacattcatggatctatttgatccacgtacgtgtgtggctagcattcgtgtctttatatgcctcatatctatgtttattaaatacttcattatgtatgtatgtatgtatatatatatatatatatatatatatatatatatatatatatatatatatatatatatatatatataaaaaaaaaaaaaaaaaaaaaaaaaaaaaaaaaaaaaaaaaaaa

SEQ ID NO: 250 - protein, 816 aa, Zea mays
MAPAQHQAAADRGSREEIVIVDLESEAGADDAAAAAATMQRQDSLYAAATRAAGANHHGQDSWARTLRLAFQCVGILYGDIGTSPLFVYSSTFRDGVGHPDDLLGALSLIIYSFLLFTVIKYVYIALRANDDGDGGTFALYTLISRHAKVSLIPNQQVEEDDLVAKYNRDKPPATLRRAEWMKELLETNKAVKVSLFLITMLATAMVISDAILTPAISVLSAVGGLKEKATFLTTDEIVWITVGILVALFAIQRFGTDKVGYLFAPIILLWLLLFAAVGFYNLVKYDTGALRAFNMKYIIDYFRRNKKKGWASLGGILLCFTGTEALFADLGYFSIRSIQLSFGFGLVPSVLLAYIGQAAYLRVHPEDVANTFYRSTPISLFWPTFILALAASIIGSQAMISCAFATISHSQTLGCFPRVKILHTSRQYSGQLYIPEVNYLLCLGACLVTVGFRTTVIIGEAHGICVVLVMIVTTLLLTIVMLLVWKISVWWIVAFFLVFMSSESIYLSAILSRFAHGAYVPVAMSAVLMVVMVVWHYVHVNKYRFELEHSIPRDKVKELLERSDIQRVPGIGLFYTELVQGIPPVFRHLIEKIPSIHSVLIFVSMKHLPIPSVDMSERFLFRQVDREDYKVFQCVARYGYRDPFEEAKDFVDKLVEHLQYYIRDVNLYGLGCEPMMKQSFSYCSSRAESFGSHEKTKVKAVYAEEMLTPAESFSEHARQASEKTKLFTQFQGDKMNIVEMMKIQQEQQAVLEEMSKGVVYILGETEVVARPQSSLIKKIAVNYIYSFLRKNFMQGEKMLSIPHGKLLKVGISYEI

SEQ ID NO: 251 - DNA, 1996 bp, Zea mays
ctctgaactctgatcagagatcaaagaggtagccgttaagttaacgatggcttccgccgacctcgcagaggccatggagcccgggaagaagagcaacgtcaagtatgcttccgtctgtgccatcatggcctccatggcctgcgtcatccttggctacgacattggtgtgatgagtggagcggcgatttacatcaagaaggacctgaagatcacggacgtgcagctggagatcctgataggcatcatcagtctctactcgctcatcggatccttcgctggcgcgcggacgtccgacaggatcggccgccgcttgaccgtcgtcttcgccgcggtcatctttttcgtgggcgcgttgctcatgggcttctccgtcaactacggcatgctcatggtgggccgcttcgtggccggagttggcgtgggctacgggggcatgatcgcgcccgtgtacaccgccgagatctcgccggcggcgtcccgcggcttcctcacgtccttccctgaagtcttcatcaacctcggcatcctgctcggctacctgtcgaactacgcatttgcgggcctcccgctccacctcggctggcgtgttatgctcggcatcggcgcggcgccgtccgccctgctcgcgctcctggttttctgcatgcccgagtcgcctcggtggcttgtcatgaagggccgcctcgcggacgccagggcggtgctagagaagacctccgcctcgccagaggaggccgcagagcggctggctgacatcaaggttgccgcggggattccgaaggacctcgacggagacgtggtcaccgtacccaaggagcgaaacagcggtgagatgcaggtgtggaaggacctcatcttgtccccgaccccggcgatccgacgcatattgctatcggccgtcggcctgcacttcttccagcaggcttctggctgcgattctgtcgtgctgtacagccctagcgtgttcaggagcgcgggaatcaccggcgacaacaagctcctgggcgtcacctgcgccgtgggcgtcaccaagacgctcttcatcctggtggccacgttcctgttggaccgcgtggggcgtcggcctctgctactgaccagcacgggtggaatggtcatctcgctcatcagcctcgggacggcgctcaccgtcgtggggcatcacccggacgccaagatcccgtcggtcgtcgctctgtgcatcgcgtccaccctggccttcgtcgccttcttctctatcggcctcgggcccatcacgggagtgtacaactcggagatattcccactgcagctgcgcgcgctgggctttgcggtcggcgtggcgtgcaaccgcgtaaccagcgccgttatctccatgaccttcctgtccctctccaaggctattaccatcggcggcagcttctttctctactccggcatcgccgcggtcgggtgggtttttttcttcacgtgccttccggagacccgtggtcgtacgctggaggagatgggcaagctgttcggcatgccagacacggacatggctgaagcagacgacaccgcagccaaggagaaggtggtggaaatgtccaccaagtaggcaagtagatggaacgaaaatacaatattcggcggtgctcgggcagataggcaatgattggtgcagcgtcgcttacaagagcagagctcaacccaacacaaacaaaataaggaaaaaaaaactgaagcagcgtggcaagattggcctctgagaatcagagatgtcgtggtgcactagtgctgcaggacagagacggcgtggtccagcaagagacttccgcgagacaggctgccaagtgacagctatgagtcattgttgtcagagtcgcgtgtgctttgtcatgatcgatgatgtttttgtccttattttacaagaaaattccctctcaacgaatgtaaccaacaaaccattctatgtttttttgacccgtcttgtttctttctttgtttttgatatagttcattgcaggaaaaaaaa

SEQ ID NO: 252 - protein, 510 aa, Zea mays
MASADLAEAMEPGKKSNVKYASVCAIMASMACVILGYDIGVMSGAAIYIKKDLKITDVQLEILIGIISLYSLIGSFAGARTSDRIGRRLTVVFAAVIFFVGALLMGFSVNYGMLMVGRFVAGVGVGYGGMIAPVYTAEISPAASRGFLTSFPEVFINLGILLGYLSNYAFAGLPLHLGWRVMLGIGAAPSALLALLVFCMPESPRWLVMKGRLADARAVLEKTSASPEEAAERLADIKVAAGIPKDLDGDVVTVPKERNSGEMQVWKDLILSPTPAIRRILLSAVGLHFFQQASGCDSVVLYSPSVFRSAGITGDNKLLGVTCAVGVTKTLFILVATFLLDRVGRRPLLLTSTGGMVISLISLGTALTVVGHHPDAKIPSVVALCIASTLAFVAFFSIGLGPITGVYNSEIFPLQLRALGFAVGVACNRVTSAVISMTFLSLSKAITIGGSFFLYSGIAAVGWVFFFTCLPETRGRTLEEMGKLFGMPDTDMAEADDTAAKEKVVEMSTK

SEQ ID NO: 253 - DNA, 2014 bp, Zea mays
tgatcacacagcgacaccgcgcggttcgttaggaaaggaaatcgattcccccgcatctgatctcttcggtgctagagaaatataggccgccgcctcctcctcctcattcggtgaaaggtgggcggttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaagttctccgctgcttactcgaactgcgcgaggaagccatcctgatatctctgtcgtcatccccatcctagtagcgtagaaaccacctgcattttcattttgatctccctaatccctccggctagctgctttccagtgaccaaaagatatcaaagaccacttcccgtcttcctcccgtggctgtctgtcatctggctctgaaacgatggcagtcctgcaagttgctgctgctgcccctccccctgtctctgtgattgggttcgagggatttgagaagcgccttgagatcagcttctctgaggcacctgtcttggctgaccccagcggaaggggactgcgtgcgctctcgcgtgcccagatcgactctgttcttgaccttgctcggtgcaccattgtgtccgagctctcaaacgaggacttcgactcttatgtcttatctgagtcgagcctgtttgtctacccatacaagattgtgatcaagacctgtggaactacaaagcttctgctcgctattccgaggatccttgaacttgctgaagagctcctgttgccactcgctgcagttaaatactcccgtggaacgttcatattccctgaagcacagccttccccacacaagaacttcgctgacgaggttgccttcctgaatcgcttcttcggtggcctcaagtccggtggcaatgcttatgtgattggtgactctgcgaagcccgggcagaagtggcacgtctactacgccgctgagcaccctgaggagcctgttgttactctagagatgtgcatgactgggctggacaagaagaaagcttctgtcttcttcaagaccactgctgatggttactcgctgtgcgccaaggagatgaccaagctctctggtatctcggacatcatcccagagatggagatctgtgacttcgacttcgagccctgtggctactccatgaatgctgttcatggccctgctttgtcgaccattcatgtgaccccagaggacggcttcagctatgcaagctacgaggtcatgggctttaacccgggctctttctcttatggtgacctggttaagagggtgctgaggtgctttggtccaactgagttctctgttgccgtgaccatcttcggtgatcgggacaatgcgaagacctgggggacgaaactggatgctgaggcctatgcttgcagcaacatggttgagcaggtgctgccgtttggtggcttgctcatctatcagagcttcactgttacggccgaaacgacccatgggtcgccgaggtcagtcctgcatgacttcgctggtgacattgtcaagaatcgctcagagagtgatgctccctgggaagctgatgctgtggatgagagcgaggaaagagatgtaaagaagatgaaatgctgatgtggtcgacgatagatcagattcagagttgctgccactggttatcttgtgaagcagccaagcctaattatttatgccacataacctgtgctattgtaatgtgtcacatgcttatatttgcaataaacagctctaggtggtcagctttgtctgccgcaatgagcagtgtatcgatattgtggttttgaattgtttggatctaaataaagtcttgtgttcgatacaaaaaaaaaaaaaaaaaaaaaaaaaaaaaaaaaaaaaaaaaaaaaaaaa

SEQ ID NO: 254 - protein, 395 aa, Zea mays
MAVLQVAAAAPPPVSVIGFEGFEKRLEISFSEAPVLADPSGRGLRALSRAQIDSVLDLARCTIVSELSNEDFDSYVLSESSLFVYPYKIVIKTCGTTKLLLAIPRILELAEELLLPLAAVKYSRGTFIFPEAQPSPHKNFADEVAFLNRFFGGLKSGGNAYVIGDSAKPGQKWHVYYAAEHPEEPVVTLEMCMTGLDKKKASVFFKTTADGYSLCAKEMTKLSGISDIIPEMEICDFDFEPCGYSMNAVHGPALSTIHVTPEDGFSYASYEVMGFNPGSFSYGDLVKRVLRCFGPTEFSVAVTIFGDRDNAKTWGTKLDAEAYACSNMVEQVLPFGGLLIYQSFTVTAETTHGSPRSVLHDFAGDIVKNRSESDAPWEADAVDESEERDVKKMKC

SEQ ID NO: 255 - DNA, 2202 bp, Zea mays
ccctcccaccctctttcgtagcgcttcttcctatgcctctcgccggaacggaacagcagatagcatcacaatctccagtggctgtgggcatctttccttttcctgccataggctctaggccgtgacgggagctagcttctcgcttgcgtgcgtgcttgctccggctatcatattgcctgcctgcctgcctatgaacctctccggccaatggaggagctacttcttcttctctagcctttctcgtctctgatccacccattgaccttcggtgcgcccggccactctgcgccggcctctcgcgtgcgtctctcgtgtgagtgctacaggcaagcgaagcgatggacatgaacgagagcggcgagaaagggatggagggcaacgcgtcctccggcatcccggtggactggcagacccaattcagcgccgccgccttctcgtgcgcgccgccgcagcagcagcaggttcccatgatggactccgccttcgcgtccgccggcctgtgggcgtccacctcccaggccatggcgctctccgacgcgggcggcaggtcggccgcgcgggccggcttcttggcgccggtccccggtttcctcccgcagggcctcgcccatttccccgtggactccggcttcatcgagcgcgccgcgcgggcttcctgcttcggcggcggcggcggcggcggggtgatggctgccttcggcgcagcagctgatcatcaacccatgaacagcgcgttcagtggatcctcggaggcgctgctggaccaccagaggacgaaggacggcagcgacaagggcgagccggagctcggccggaacggccacgacggggttctgagctcggaggcggctgctgcgggggactgctcgtccaaggggacgtccgactccaagaagaggagaaggcctaacgaggtgatgggaggcgatcaggtccagtcgtcgaacctgcccgccgactcagcgaacgagagcgtgcacagcaaggacaaaggcgaggagagcagcccaaccaccaccggacccggcaagtcgaaaggaaagggggcgagagagacctccgagtcccagaaggaagactacattcatgtccgagctcggcgcggacaggcaaccaacagccacagcctagcagaaaggttgaggagggagaagattagcgagaggatgaagctgctgcaggacctcgttcctggctgcagcaaagtcactgggaaggcggtgatgcttgacgagatcatcaactatgtccagtccctgcaaagacaagtcgagttcttatcaatgaagctcgcaacggtaaacccaaggctcgacctcaacatagaagggcttctatcgaaagatcttctccgcttccctggcgttccttcgtcttcccttggattctccccggaaatgatgcacccacagctgcagctctcgcagccaggcctgatccagggcggcgctgccggcatggccaatccggacgtgttcaggagaatcaggcaggcacagttaagcgcaaaggacgggtctcagccgccccacgcattgaatggggcattcagtgacgtcgcgcagcagcagatggcgtacccgtcgtcccaggacctgagcatcgggccgtcgcaggacgggtttcaaatgtgactgaacatgcccagctgcacatactagtaaaagatgcaaaaaaagggcttcttccatctgaggagtatctgatcggcgaacgtgcgggcgcgcagggggccgcgtatagctgcctgctggtgccgggagcagcagcgcctgctcagcgcgacgccttgaaccgcgtcgacccacggctgtgcctgtgctgctgcatcggtcaggtttttttatcgtgttcagaaggaactgaggaaaagctcgtggcgctggcctgtggcgttgcctggatagatggctggaaattctgtctgtttcggcggtcgcgtgcattcatggcatggcgcgcagtgcagtaacagtgggctgcgtgttggcacttggcacagcgaccaaatgagctgctgcaggatgtgatgcaacgcgaggagccttgttttgttagtagtttccaatgctttttttttgtttttgtttgcataatagctaagggtgcaagaaaacactcataaatttgggggtggggggcggcggtccggcgatgtctatgttgaaacatcatacatttggcaaaaaaaaaaaaaaaaaa

SEQ ID NO: 256 - protein, 431 aa, Zea mays
MDMNESGEKGMEGNASSGIPVDWQTQFSAAAFSCAPPQQQQVPMMDSAFASAGLWASTSQAMALSDAGGRSAARAGFLAPVPGFLPQGLAHFPVDSGFIERAARASCFGGGGGGGVMAAFGAAADHQPMNSAFSGSSEALLDHQRTKDGSDKGEPELGRNGHDGVLSSEAAAAGDCSSKGTSDSKKRRRPNEVMGGDQVQSSNLPADSANESVHSKDKGEESSPTTTGPGKSKGKGARETSESQKEDYIHVRARRGQATNSHSLAERLRREKISERMKLLQDLVPGCSKVTGKAVMLDEIINYVQSLQRQVEFLSMKLATVNPRLDLNIEGLLSKDLLRFPGVPSSSLGFSPEMMHPQLQLSQPGLIQGGAAGMANPDVFRRIRQAQLSAKDGSQPPHALNGAFSDVAQQQMAYPSSQDLSIGPSQDGFQM

SEQ ID NO: 257 - DNA, 1107 bp, Zea mays
ctcctgctcactcactcccttggccttctccagtcctctgtcctcgatcgatcggcttgtttacttccttagcttggagatccatttccatggaccctcacctcagctcccacgttcacgcggcagctgcggcggcctcggctttccccgatggtaagaagttggagagtgacgtgctgcctccaggggtcgtgaccctcgacgtcgaggcgggtgcgccgacgaacgcggccggggccgatccgcgcgacggcgacgacggggacgccggcttcgactacatggcccgcgcgcagtggctccgcgcggccgtcctcggcgcgaacgacggcctcgtctccgtggcctccctcatgatcggcatcggcgccgtgaacgcgacgcgcaaggccatgctggtctccggcatggcggggctcgtggccggcgcctgcagcatggccatcggcgagttcgtctccgtgtacgcgcagtacgacatcgaggtctcgcagatcaagcgcgacggcgaggaagccgccagggacagcctgccgagcccgacgcaggccgcgatcgcgtcggcgctggcgttcgcgtttggcgccctcctgccgctgctggcgggggtgttcgtaccgtcgtgggccgccagggtggccgcggtgtgcgccgcgaccagcgtcggcctggccgggttcggcgtggcgggcgcgtacctgggcggcgccaacatgctgaggtccggcctgagggtgctcctgggcggctggttcgccatgctcgtcacgttcggtgtgctccggctgttcgggacggtcttccacatacaagtctcgtcggcgtgatagctctcggagtctcgggctatggtggcaaatgaaataacgatccagggcccaggggcctagctatagctcttgacatcggaatgtgaaattaaaacctgcatgtcttgagtaaaaaactagcggtcgcctggatagcgaaatagaggcatgggtgtgggtgtgtccgtgtggcagtggatgtactgctttattgtaatgttatcttgtgctactggtatctgctgacgagaaaatcgaacacagattgtataattgtattaaaaaaaaaaaaaaaaaa

SEQ ID NO: 258 - protein, 245 aa, Zea mays
MDPHLSSHVHAAAAAASAFPDGKKLESDVLPPGVVTLDVEAGAPTNAAGADPRDGDDGDAGFDYMARAQWLRAAVLGANDGLVSVASLMIGIGAVNATRKAMLVSGMAGLVAGACSMAIGEFVSVYAQYDIEVSQIKRDGEEAARDSLPSPTQAAIASALAFAFGALLPLLAGVFVPSWAARVAAVCAATSVGLAGFGVAGAYLGGANMLRSGLRVLLGGWFAMLVTFGVLRLFGTVFHIQVSSA

SEQ ID NO: 259 - DNA, 1886 bp, Zea mays
ctgcaagtcgtcttcttccccaagcctaaaaccaacaacagtttggcagatcgcccggctcgatcgatcgcagccatggtgctctccaaggccgtctccgagagtgacatgtccgtgcactccacgttcgcgtcgcgctacgtccgctcgtctctcccaaggtaccgcatgccggagaactccatccccaaggaggcggcgtaccagatcatcaacgacgagctcatgctcgacgggaacccgcgcctcaacctggcgtccttcgtcaccacctggatggagcccgagtgcgacaagctcatcatggccgccatcaacaagaactacgtcgacatggacgagtaccccgtcaccaccgagctccagaaccggtgcgtgaacatgatcgcgcatctcttcaacgcgccgttgggcgagtccgagacggcggtgggcgtcggcacggtgggctcgtcggaggccatcatgcttgccgggctggccttcaagcgcaggtggcagaacaagcgcagggccgagggcaagccgttcgacaagcccaacattgtcaccggcgccaacgtccaggtttgctgggagaagttcgcgaggtacttcgaggtggagctcagggaggtgaagctgcgcgacggctactacgtgatggaccccgagaaggcggtggagatggtggacgagaacaccatctgcgtcgccgcgatcctgggctccacgctcaacggcgagttcgaggacgtgaagctgctcaacgacctgctccaagccaagaacagggagacccggtgggagacgcccatccacgtggacgcggcgagcggcggcttcatcgcgcccttcctgtacccggacctggagtgggacttccgcctgccgctggtcaagagcatcaacgtcagcggccacaagtacggcctcgtctacgccggcatcggctggtgcatctggcgcagcaaggaggacctgccggaggaactcatcttccacatcaactacctcggcgccgaccagcccacgttcacgctcaacttctccaagggctccagccaagtcatcgcgcagtactaccagctcatccgccacggcttcgaggggtacaggaacatcatggagaactgccacgagaacgccatggtgctcaaggagggcctggagaagacgggccgcttcgacatcgtgtccaaggacgaaggcgtcccgctggtggccttctccctcaaggaccgcagccggcacgacgagttcgagatctcggacatgctgcgccgcttcggctggatcgtgccggcatacaccatgccccccgacgcgcagcacgtcacggtgctccgcgtcgtcatccgggaggagttcagccgcaccctcgccgagcgcctcgttctcgacatcgagaaggtgatgtaccagctggacgcgctcccgtccaggctcccgccccctcccccggcggcgccgctgctcaggaaaaagacggagctggagacgcagaggtcggtcacggaggcgtggaagaagtttgtgctcgccaagaagaccaacggcgtctgctagtgacgcttccaccgctacacacaacactaccatggtcaacgggccttcttccgtgctgatttgagtgagcaccgcgatatctaggtagtctaatatgcttcgtgtctttccgtaatttgtgcatgcagttgctatgcaccgagtgagttgctatatatgttcgatagcaacagtttttttctccccaatgcaaggaagagagtaatagttgaggctggtgtcgattattgttatccatgcccatgcgcgtgcagttattacctccattctaaactgtaatctattttaatttcttcagagagtcaaagcacctcaagatttattaaaactataagaat

SEQ ID NO: 260 - protein, 490 aa, Zea mays
MVLSKAVSESDMSVHSTFASRYVRSSLPRYRMPENSIPKEAAYQIINDELMLDGNPRLNLASFVTTWMEPECDKLIMAAINKNYVDMDEYPVTTELQNRCVNMIAHLFNAPLGESETAVGVGTVGSSEAIMLAGLAFKRRWQNKRRAEGKPFDKPNIVTGANVQVCWEKFARYFEVELREVKLRDGYYVMDPEKAVEMVDENTICVAAILGSTLNGEFEDVKLLNDLLQAKNRETRWETPIHVDAASGGFIAPFLYPDLEWDFRLPLVKSINVSGHKYGLVYAGIGWCIWRSKEDLPEELIFHINYLGADQPTFTLNFSKGSSQVIAQYYQLIRHGFEGYRNIMENCHENAMVLKEGLEKTGRFDIVSKDEGVPLVAFSLKDRSRHDEFEISDMLRRFGWIVPAYTMPPDAQHVTVLRVVIREEFSRTLAERLVLDIEKVMYQLDALPSRLPPPPPAAPLLRKKTELETQRSVTEAWKKFVLAKKTNGVC

SEQ ID NO: 261 - DNA, 1908 bp, Zea mays
cgcacggccacacctgccctccattccatccagcacctagaaaaaactaatcgcaattagttgacgcataatattttgagggaggagaaggggggaattgactagttgaccaatcgcgagtggcgatgatgatgcagttgggggccaggagtttggtgaggaggttctcccgtctcgccgcggcgggggccccggccgagacgacgtcggctggcgtgccgcgaatgccggcgttcgaccacgtcccgctgccctacgacgggccgagcgccgccgacatcgcccgcaagcgcgccgagtacctcagcccgtccctcttccacttctactccaagcctctgaacatcgtggagggcaagaggcagtacttgtacgacgagcacggccggcgctacctggacgcgttcgccggcatcgccaccgtgtgctgcggccactgccaccccgacgtcgtggacgcgatcaccaggcaggccaagcgcctgcagcactccaccgtgctctacctcaaccacgtcatcgccgatttcgccgaggcgctggcatccaagctgcccggcgacctcaaggtcgtctttctcacctccggcacggaggcgaacgagctggccatcctgatggcgcggctgtacaccggctcccacgacatcatctccctccgcaactcgtaccacggcaacgcggccgggaccatgggagccaccgcgcagaagaactggaagttcaacgtcatccagagtggcgtgcaccacgcggtgaacccggacccctacagaggcgccttcggctccgacgccgagaagtacgtgcgggacgtgcaggagatcatcgagttcggcaccaccggccaggtcgccggcttcatatccgaggccatccagggcgtgggcggaatcgtggaggtgtcgccgggctacctgccgctggcgtacgacaaggtccggaaggccggcgggctctgcatcgccgacgaggtccaggcgggtttcgcccgcgtcggcagccacttctggggcttcgagacccacggcgtcgtccccgacatagtgaccatggcaaagggcatcggcaacggcatcccgctgggcgccgtggtgacgacgccggaggtcgcgcaggtgctgacccggcgctgctacttcaacacgttcggcggcaacccgctgtgcaccgccggcgggctcgccgtcctcgaggtgctcgagaaggagaggctccaggagaacgccttcgtcgtcggctcctacctcaaggaccgcctccgcggtctccaggagaagcacgagatcatcggcgacgtgaggggaacgggtttcatgctcggcatcgagctggtcaccgatcggcagctcaagacgccggcgaaagatgagatctgccacgccatggaacacatgaaagatatgggcgtcttggtcggcaaaggcgggttctatgggaacgtcttcaggatcactccccctctatgcttcaccaaggaagatgctgatttcttcgtcgaggtgatggacattgcgctgtcgaagctctgagctgtggccgtcaggcggaggggcggtgtgtctgtctgtatatataatcctcgcccgagtttagcagctgcgtcggagttgtactatctcactcaagagaatggcgaaaaaaccttggcagtttgtgactcaaggggaaaaaactaaaccatgcagacgaatttggcttatcgcaacgctagcttttaattcagctttcgtctggagatgacgtgccttgtaacgtgccagagataatgactggggactggggttcattttaccttacttatataaaaacagattttatatgatccttgtaagcgagttgatctaaactcatatggacgtgatgagttatgaatctggtttatatatgaggtacagaacatcaagg

SEQ ID NO: 262 - protein, 468 aa, Zea mays
MMMQLGARSLVRRFSRLAAAGAPAETTSAGVPRMPAFDHVPLPYDGPSAADIARKRAEYLSPSLFHFYSKPLNIVEGKRQYLYDEHGRRYLDAFAGIATVCCGHCHPDVVDAITRQAKRLQHSTVLYLNHVIADFAEALASKLPGDLKVVFLTSGTEANELAILMARLYTGSHDIISLRNSYHGNAAGTMGATAQKNWKFNVIQSGVHHAVNPDPYRGAFGSDAEKYVRDVQEIIEFGTTGQVAGFISEAIQGVGGIVEVSPGYLPLAYDKVRKAGGLCIADEVQAGFARVGSHFWGFETHGVVPDIVTMAKGIGNGIPLGAVVTTPEVAQVLTRRCYFNTFGGNPLCTAGGLAVLEVLEKERLQENAFVVGSYLKDRLRGLQEKHEIIGDVRGTGFMLGIELVTDRQLKTPAKDEICHAMEHMKDMGVLVGKGGFYGNVFRITPPLCFTKEDADFFVEVMDIALSKL

SEQ ID NO: 263 - DNA, 2058 bp, Zea mays
gcggcaacgggtcgtcgtctcctcacctcgccggggctttacttatccaccgcagggccaccgagcgaggcgataacccaaccagtatcagccagctcgcagtccctccgccaccaattttttttttctcattctcgtttccaaattatccgccgctgaaacaatctgcacccccacgcacaagcacgaagcagtcagcagtagagtacaaatcctcgcctgcatcctggttttcgtccccattctctccccgccactccagcggaacggcggcgggggagtgagtgacggcaacgaggcaagatggcgaggaggaggccgatggactacgaggagctgaacgagaaagtcaagaaggcgcagtacgcggtgcgcggggagctgtacctccgcgcctcccagctccagaaggagggcaagaagatcatcttcaccaacgtcggcaacccgcacgccctcggccagaagccgctcaccttcccgcgccaggtggtggcgctgtgccaggctccgttcctcctcgatgaccccaatgtcggcctcatgttcccgcccgatgccatcgtgcgggccaagcgctatctcgccatggcgccgggaggtctaggtgcgtacagtgatgcccgtggtatccccggaatcaggaaggaagttgctgacttcatccacaagcgtgatggatatccgagtgacccagaactcatttacctgacagacggcgccagcaaaggtgtgatgcaaatgctgaatgccatcattagaaacgagagggatgggatcttggttcctgttcctcagtacccactttattctgctatcatttccctctttggtgggtctctggtcccatactacttggaagaagaggctaactggaaccttgactttgcaaacatccgacaagcagtggccgaggcacgttcgaagggaatcactgttcgagcgacggtgattataaatccaggaaatcccactggccagtgccttagtgaagcaaatataagggaacttgtgcgatattgctaccatgaaaacttagttctgcttgcagacgaagtgtatcagcagaacgtttatcaagatgagcgcccatttataagcgcaagaaaggttatgttcgacatgggtccgccaataagcagggaggttcagcttgtttctttccacactgtgtccaaagggtactggggagagtgtggacaacgtggtggatacttcgaaatgacaaatcttcctccaaagacagtagatgagatctacaaggttgcatcaatagtactgagtccgaatgttcccgggcaaatctttatgggagtgatggttaaccctcctaaacctggagatatctcatacccgaagttcactgccgaaagcaagtccatcctcgaatctttgaggaggagagcgcgcatgatgacagacggtttcaacagctgccgaaatgtggtgtgcaatttcacagaaggagctatgtactctttcccccaaatacagctgccagcaagagccatcgaggcggcaaagagagccggcaaagcagcagacgttttctactgcctcaagctcctggaggcaacggggatttccactgttccgggatctggttttgggcagaaggaaggggtgttccaccttcggacaactatccttccagccgaggaagacttccctaccatcatgtcgagcttcaagaagttcaacgactcattcatggagcaatacgagggctactccaggatgtgatgtcaacatgaaaagaagcgaccgcgccaccattttgcttctactgcccatactagtagaacagtgatcggtgcactatgtgatattttgctgctgcaactgcgccactcggccttagtctgctatgtatgtgttgcctgttctgaaagagtaaagaagcgaccgataatgtatcctgagccgcgcggcggggagaaagcatttcgctttcaagggaaagggaagcatcagcagcgccgccgccgctagagccctagacagacttaatcgctatctgggtcagtccaaaacagtggaaacaaacccgacagagga

SEQ ID NO: 264 - protein, 479 aa, Zea mays
MARRRPMDYEELNEKVKKAQYAVRGELYLRASQLQKEGKKIIFTNVGNPHALGQKPLTFPRQVVALCQAPFLLDDPNVGLMFPPDAIVRAKRYLAMAPGGLGAYSDARGIPGIRKEVADFIHKRDGYPSDPELIYLTDGASKGVMQMLNAIIRNERDGILVPVPQYPLYSAIISLFGGSLVPYYLEEEANWNLDFANIRQAVAEARSKGITVRATVIINPGNPTGQCLSEANIRELVRYCYHENLVLLADEVYQQNVYQDERPFISARKVMFDMGPPISREVQLVSFHTVSKGYWGECGQRGGYFEMTNLPPKTVDEIYKVASIVLSPNVPGQIFMGVMVNPPKPGDISYPKFTAESKSILESLRRRARMMTDGFNSCRNVVCNFTEGAMYSFPQIQLPARAIEAAKRAGKAADVFYCLKLLEATGISTVPGSGFGQKEGVFHLRTTILPAEEDFPTIMSSFKKFNDSFMEQYEGYSRM

SEQ ID NO: 265 - DNA, 1702 bp, Zea mays
atggacgccggcgacgcctccaccgcgcttgccctcacggcggcggaaccatcaccgccgagccccaacaggaggggcaagaggccgaccaacccgcccaagcgcttcgtgcacaccccgatcccgccttcaatcctctcggacccgaccctggccgccgccgccacctccctcctcccggccaactacaactttgagctccacaagacggcgcaccgcatacggtccgcggccgctcgccgcgtggcgctgcagctccccgagggcctgctcctcttcgcgctcccactgtcgcacctcctcgcgccctacctcgagcccggcgccgacaacgacgtcctcgtcctcgccgacgccacctacggggcctgctgcctcgctgaccgccccgccagggcgctcgccgccgacctcctcgtccactacggccactcctgcctcgtccccgtcacggcctcactcctcccggtgctctacgtcttcgtcgagatccgcgtggacgccgcccgcctcgccgccgccgtcagagccgccttcccggacccagcggccgcgccccgcctcgccatcgccgggaccgtgcagttcatcgccgcggtccacgccgcgcgcgagatgctcacggtagagggctaccacgacatcgtcgtgccgcaggcgaagccgctgtccgccggcgagatcctgggttgcaccgccccgacgctcaagaagtcggaggaggtgggcgccgtggtgttcgtcgccgacgggaggttccacctcgaggcgtttatgatcgccaatcccggggtgaaggcctaccgtttcgacccattcctcggggttctcgtgctggaggagtatgaccatgttggcatgaagcaggcgaggaaagcggcggtgctggcggccaggaaggccaagagctggggagtcgtacttggcaccctggggaggcaggggagcaccaaggttcttgacagggtggtggagcatttggaggagaaagagttggaacacacagtggtgctcatgtcggagctttccccggcgaggatggagctatttggagattccattgatgcctgggtgcaaattgcttgtccacgcttgtcgatcgactggggggagggtttcaagaagccagtgctgacaacgttcgagtttgatgtcgcactgggctatgtccctgggtggtgggagaaggggagcaggggttgcggtagtgaatgtggtgttgggtgttgttcaggatcaggaactcgtggaaactgcaactgcagtgatggggattatggtggtgactacccgatggattattattcgcaagatggaggtgattggaatagctgctacatgaagaagaagccatctactggcgagaggaaactgcgggttcggattggcaacgaaattcaagccgaggagaagcgtgggaatcaggattctcgtgagctagtcaggtgaatagggataccgagaacagcttcatggctcaaaaaggatttttgacaccaggttttagtgtgattgtaacgatgtttagttaccagagggaaaatcttgtgactgtacctgtatcgatgtatccaccaccccatatactgtaaatttgttacgtacaatgtctcattgtaaacatcttgagaaggtatgaggtgttgtcatacccattggtgcaaccatccaaaaaaaaaaaaaaaaaaaaaaaaaaaaaaaa

SEQ ID NO: 266 - protein, 482 aa, Zea mays
MDAGDASTALALTAAEPSPPSPNRRGKRPTNPPKRFVHTPIPPSILSDPTLAAAATSLLPANYNFELHKTAHRIRSAAARRVALQLPEGLLLFALPLSHLLAPYLEPGADNDVLVLADATYGACCLADRPARALAADLLVHYGHSCLVPVTASLLPVLYVFVEIRVDAARLAAAVRAAFPDPAAAPRLAIAGTVQFIAAVHAAREMLTVEGYHDIVVPQAKPLSAGEILGCTAPTLKKSEEVGAVVFVADGRFHLEAFMIANPGVKAYRFDPFLGVLVLEEYDHVGMKQARKAAVLAARKAKSWGVVLGTLGRQGSTKVLDRVVEHLEEKELEHTVVLMSELSPARMELFGDSIDAWVQIACPRLSIDWGEGFKKPVLTTFEFDVALGYVPGWWEKGSRGCGSECGVGCCSGSGTRGNCNCSDGDYGGDYPMDYYSQDGGDWNSCYMKKKPSTGERKLRVRIGNEIQAEEKRGNQDSRELVR

SEQ ID NO: 267 - DNA, 1898 bp, Zea mays
gcgcagcgcaagctcgatcaccacaccaaccagactcagaacatccagaactcagagcttctacttctagaacagaagaacatcgagatcagtcctcccctgcatcctccaccggcctcacctagatgagcacctcgtacaccgaggcgcagttcggctccttgttagacctgcccgccggagacgacctcacgtcctggttcacacacctgtgcggcgaggagcaggcggcggcgctgccggcgttccaggcgccggtggcgatggcggaccccaggaagaggagcgccgagtaccagctcctggaaggggaggcgtccggggtcaagaggcagcgctccccgaccagcagctcccgggagaacagcgccggcagcaatgacggcgactacgagcacacgtccgcagccgcagccgcagccgcagccggcggcggtggcggaggcaggggcggcggccgccgcctctgggtcaaggagcgcgaccacgagtggtgggaccggatgagcagccccgcgtgccccgacgacgagttccgccgcgccttccgcatgtcccgggccaccttcgaggccgtgtgcgaggagctgggcgccgccgtcgccaaggaggacaccatgctgcgcgccgccatccccgtccgccagcgcgtggccgtctgcatctggcgcctcgccaccggggagccgctccgcctcgtgtccaagcgcttcggcctcggcatctccacctgccacaagctcgtcctcgaggtctgcgccgccatcaaggccgtgctcatgcccaaggccgtgcagtggcccgaggcgcccgacgccgccgcggccgagtccgccaggttcgaggccgcgtcggggatcccgggcgtcgtgggcgccatgtacaccacgcacatccccatcatcgcgcccaaggccaacgtcgccgcctactacaaccgccgccacacggagcgcaaccagaagacgtcctactccatcacggtgcagggcgtcgtggacgcgggcggtgccttcacggacgtctgcatcggctggccgggctccatgtccgacgccgacgtgctcgaccgctccgcgctctacctgcagcgaggcgccgcgggcctgctgcaggggcagcgcctggtgggcggcgccgggtacccgctcatggactggctgctggtgccctacacgcaccacaacatgacgtgggcgcagcacgtgttcaacgagcgggtggacggcgtgcgcgccgtggccagggacgccttccagcgcctcaagtcccgctggggctgcctccagaagcgcaccgaggtgaagctgcaggacctccccgtcgtgctcggcgcctgctgcgtcctccacaacatctgcgagcgcgccggagacgccgtcgaccccgacatcgcgttccagctcttcgacgacgacatggtggccgagaaccccgtgcgctccacggcggccgtcgccgcgcgcgacaacatcgcccacaacctcctccaccgcagcagcagtagcagcgccgccgccggccccaggttcgccttcaattgaactctgacggcgggggcgaggaaaagcagctcgctttctcggcggaatcagagaagacgacgccacgaggctcagcaatctttcaccgtttttttcgcttgaatgaaattgtaataagttgggaacatagcaacgggggttgatagcgaaacatacatagggttcaaagatacagtaggtgattggttgataggatttgagattgttctgcatttttttttgtagagtcaaaggttcaatcatcatttttcagatttggtgagaccgcgtagcctgtgtagtcaatactgtgcaggctattttgccaccagactttgcaatcaatcggtttttagctaaaaaaaaaaaaaaaaa

SEQ ID NO: 268 - protein, 472 aa, Zea mays
MSTSYTEAQFGSLLDLPAGDDLTSWFTHLCGEEQAAALPAFQAPVAMADPRKRSAEYQLLEGEASGVKRQRSPTSSSRENSAGSNDGDYEHTSAAAAAAAAGGGGGGRGGGRRLWVKERDHEWWDRMSSPACPDDEFRRAFRMSRATFEAVCEELGAAVAKEDTMLRAAIPVRQRVAVCIWRLATGEPLRLVSKRFGLGISTCHKLVLEVCAAIKAVLMPKAVQWPEAPDAAAAESARFEAASGIPGVVGAMYTTHIPIIAPKANVAAYYNRRHTERNQKTSYSITVQGVVDAGGAFTDVCIGWPGSMSDADVLDRSALYLQRGAAGLLQGQRLVGGAGYPLMDWLLVPYTHHNMTWAQHVFNERVDGVRAVARDAFQRLKSRWGCLQKRTEVKLQDLPVVLGACCVLHNICERAGDAVDPDIAFQLFDDDMVAENPVRSTAAVAARDNIAHNLLHRSSSSSAAAGPRFAFN

SEQ ID NO: 269 - DNA, 618 bp, Zea mays
catcgctcacacagtcagaccgacgcactcactaacacacacacacgaacacacaacttctccatacacgccttagccatggcttccgctgcgcagaagaagatgacaattgtttgcttgatgctgctggccgtcgtcggccaaatcgtcgctgatgatgatgttaccgtagaacatcccagccgcatctgcaccgaaacggtgattgatcctcgtgttcccaacaacgtgtgcatctgctccaagaactgcgcctgtgccggcaagtgtatccttgagtcggctgatgctgtccagacctgctttgtcgactgcgtcctcaagaacgactgcatctgcagcaacaagatcatccccggcgctgacgacccaaaggctaatgccaagtgaagtagtactgctatcagcctatcatcatccccaataatggcgtacgtacctaaataaacgacctcccatgcatgcaccaacggggagagttaagtgtgtaataattaacggccggtatgtctgtacgacggcgcgtcttgtttgtaacaataaaccccttgttttgtacgtgtaataataaaccactgtccacgcgccttacacgtaaaaaaaaaaaaaaaaaaaaaa

SEQ ID NO: 270 - protein, 103 aa, Zea mays
MASAAQKKMTIVCLMLLAVVGQIVADDDVTVEHPSRICTETVIDPRVPNNVCICSKNCACAGKCILESADAVQTCFVDCVLKNDCICSNKIIPGADDPKANAK

SEQ ID NO: 271 - DNA, 1942 bp, Zea mays
gcggcactgcccaaaccacctctttggccacacacacgcatactgccaccgctactgcttcatcagcagctagcagcaagcggtcggtggtgcagcgctgcgccgggcaatcgaacacatggctcagatgatctccaccatgcccatgctggacgccgccccggcctcgtcagccattatgcccaagctgccggccgccgcctgcctggacgcgccgccctcgggcatcaccgtcgtgtccaggcagcacgttcgcccggacgccgcgtcggcggtcggtgacctcacgctctccgtctccgacctgcccatgctgtcgtgccactacatccagaaggggctcttcttcccggcacccgacctgcccatgtcctcggtcgtgtcgctgctcctgtcctcgctgtcgcgggcgctcgccgtcgtcccggccctcgccggccgcttcgtcacgctgcccgacgaccgcatcgtcatccgctgcaacgacgcgggcgtggacttcctccacgccgtcgcacccggcctgtcgcttgacgactttctcgtccctgacgccgacgtgccgaccaagcacacaaaggacctgttccccatggaccggaccgtgagctacgaggggcaccgtcgcccgctcacgtcgttccaggtcaccgcactcggagacggcaccgtctttatcggcatcgtcgccaaccacgccgtcgtggacggcacctctttttggcaattcttcaatacctgggcggccatctgccgcggcgagtcccccaaactgccggacttccgccgaaacttcttcggcgagtccactgccgtcctccgcttccccggcggcgtcggcccgtccgtgaccttcgacgtggacgcgcctctccgtgagcgcgtctttcacttcagcgctgacgcaattcgcgagctgaaagcgattgccaaccgccgtccgagcggtggccaagacgccgaggtgtacggcaagatggcgcaggaccccaagaatccccaagtgcgcggggagatctcgtcgttccagtcactgtgcgcgcagatatggctctcggtcacgcgtgcccggaaacgcctggcgcccgacgcgacgacgacgttccgaatggcggtgaactgccggcaccggctgcagccggccatctctcctgtctactttggcaacgccatccagagcgctgcgacgatggcgacagtctccgagctggctcgcagcgatctaaggtgggcggcaggcaagctgaacgcgacccttgcggcctatggcgacggcacgatccggcgcgcggcggccgcgtggcaggccgcaccccggtgcttcccgctgggcaaccccgacggctcggtgatcacgatggggagctcgaaccggttcccgatgtacgtgggcaacgatttcggctggggccggcccctcgctgtgcggagcgggcgcgccaacaagttcgacggcaagatgtcggcgttcccgggacgagccggggacggcagcgtggacatcgaggtgtgcctgcctccggagaccatggcggcgctgctccacgacgccgagttcatgcactacgtgtcgtgcccgtcgcatctgttgtgatgtactgcagccgtgcgggcaggcgcgagtgggggccatcggccgtgacatgccatcaggcacctgttggattgctcggtcgtccactcgtccttgcctttcgggattcaggaatactagctagttggtgtcaagacattgtatctgtctcgctttttcggagtgctgcgtgtaatcgtgtgttagcagctactagtagtagtacttggaaattggaaatgactcttatgctgcagccagcaaacgatgcaacagcggggagaatatgaaccctgtagcaagagtcagaaacaagtttctgcaaatattggcactgctggatagttcatcaaaaaaaaaaaaaaaaaa

SEQ ID NO: 272 - protein, 491 aa, Zea mays
MAQMISTMPMLDAAPASSAIMPKLPAAACLDAPPSGITVVSRQHVRPDAASAVGDLTLSVSDLPMLSCHYIQKGLFFPAPDLPMSSVVSLLLSSLSRALAVVPALAGRFVTLPDDRIVIRCNDAGVDFLHAVAPGLSLDDFLVPDADVPTKHTKDLFPMDRTVSYEGHRRPLTSFQVTALGDGTVFIGIVANHAVVDGTSFWQFFNTWAAICRGESPKLPDFRRNFFGESTAVLRFPGGVGPSVTFDVDAPLRERVFHFSADAIRELKAIANRRPSGGQDAEVYGKMAQDPKNPQVRGEISSFQSLCAQIWLSVTRARKRLAPDATTTFRMAVNCRHRLQPAISPVYFGNAIQSAATMATVSELARSDLRWAAGKLNATLAAYGDGTIRRAAAAWQAAPRCFPLGNPDGSVITMGSSNRFPMYVGNDFGWGRPLAVRSGRANKFDGKMSAFPGRAGDGSVDIEVCLPPETMAALLHDAEFMHYVSCPSHLL

SEQ ID NO: 273 - DNA, 1463 bp, Zea mays
tggcttcgataattacgagaagggcagggcaggtcgggatggtctctctctctcacccccaccgatctgggaaggcattgtcttgttgtactttcccttccggcagtggcctcgattcgcatctccttttcccgtccatgcgcgcgccggcgggcggtgccagtgccaccgcgctcgcggcggccatgaacattaagcagccgctgcacggcgcatcgacgctgttcgcgctgctctccctctcgctgctcctcctccgcctgctcctccggctccgcctggccgccttccgcgacgcggcgctgtcgctccacctgctggcgcgcctccgcctccgccccgtcctcctctgcctcccgtcagcctgccacgacggcggcgccggcgccggcgccaccacgctgcgcgtctggtgccccgccgccccatcctccaagccgccgctgctcctcctccacggcttcggcggggacgccaagtggacgtgggcgcgcaacctcccgcgcctgtcccgccacttccacgtgtacgtgccggacctcgtgttcttcggcgcgcagtcccggtccgcgtcgccgctgcgctccgtggcgttccaggcccgctgcgccgccgaggccatgcgcctcctcggcgtgccccgctacgacgtcgcggggatcagctacggcggcttcgtcgcctaccggatggccgccatgttcccggatttcctccaccgggtcgccctggtctgcgccggggtctgcctcgaggagagagacctggcggagggcctcttccccgtggccgggatcggggaggccgccgcgctgctcgtgccgcaccgcccggaggaggtgcgccgcctagtccgcctcaccttcgcgcgcccgcccctcatcatgccctcctgcttcctatgggactacatcaaggtgatgggctccgatcatatccaggagaaggctgagctgctatacgctttgattaacgggagacaactctgtactcttccaaaattgacccagccgacgcttataatctggggagagcaagatcgggtgttcccaatggagctggctcacagattgaaccggcatctagaggggaattctcgattagttgtcataaaaaatgctgggcacgcggtcaatatcgagaagcccaaggaagtgtgccggagcatcattgagttcttcaaggagcctgtcgctggagctgcaaatgcggacgacaaggtgtagtagcttccactaatggcggacgtggacaggtcttcgctgggcatcggcagacggcgcacccgcttgtggaacgcaaacacaaggcagatacgtggcattgtacatctacatccctctgccattgttctgatgtacttaaagggtgtatgtagagtcattgcagtagcgattcataaagcatgtaacggggaacagagggaaaccatagtggctcaaatccgagtgaaaccaaaaaaa

SEQ ID NO: 274 - protein, 395 aa, Zea mays
MVSLSHPHRSGKALSCCTFPSGSGLDSHLLFPSMRAPAGGASATALAAAMNIKQPLHGASTLFALLSLSLLLLRLLLRLRLAAFRDAALSLHLLARLRLRPVLLCLPSACHDGGAGAGATTLRVWCPAAPSSKPPLLLLHGFGGDAKWTWARNLPRLSRHFHVYVPDLVFFGAQSRSASPLRSVAFQARCAAEAMRLLGVPRYDVAGISYGGFVAYRMAAMFPDFLHRVALVCAGVCLEERDLAEGLFPVAGIGEAAALLVPHRPEEVRRLVRLTFARPPLIMPSCFLWDYIKVMGSDHIQEKAELLYALINGRQLCTLPKLTQPTLIIWGEQDRVFPMELAHRLNRHLEGNSRLVVIKNAGHAVNIEKPKEVCRSIIEFFKEPVAGAANADDKV

SEQ ID NO: 275 - DNA, 1746 bp, Zea mays
caacaatggaggccgcggaggagcggccaagaagacgccctgccggcctcggcgtcctcgccctactctgctcgtcgttgcttcttaacgtgctcttcctcgcgtactactacttcctctcgccgccgtcccagcttgccgatggtggcagctgcgggctgagctgggcgctgcgggcggccagggatgccgaggcgttggccgccacggacagctgctccggccacgggcaggtgttcttggacggcgtcgtcggcgaggacgggcggcctgggtgcgagtgcaatcgctgcttcgacgggccgcactgctcgatccgaacacccaactgcactgccgatgctaccagcggggacccgttgttcctggagccctactggaagcggcacgcggcggccagcgccgtgctagtgcccggatggcatcgtctgagctacgccaccaccgacggcctcttccaatccgtcgagctcgagaaccacatccggcggctgcacagggccgtcggcaacgcagtcgtggacggcaagcgcttggtgttcggcgccggctccacgcagctcatcaacgcgctggtgcacgcgctctccccggacgccaacgccgccgccgcctcgccaccggcccgcgtggtcgccaccgcgccgtattacccgccgtacagaacacagacagcgatgttcgacgggcgtgagtacagatgggaaggaaccacggcggctgcatgggccaacgcgtcacgaaactcctccagcttcatcgagttcgtcacgtcgccgaacaaccccgacgccctgctccgcgcgcccgttctgcgcggctccgcggtgatcgccgaccacgcgtactactggcctcacttcacgcacatcgcggcaccggccgacgaggacgtcatgctgttcaccatgtccaagccatctgggcatgccggcagcagactcggatgggcgctgatcagggacgagaaggtggccaagagggcgtacgagtacgtgcagagcagcatcatgggcgcgtcccgggacacccagctgcgcatgctggagatcgtgaaggtcatgctggccaacctgcacggcgaggaggacatcttcgcctttgggcacgacgtgatgcgaaccagatggcgcaggctgagcgccgtcgtgtcgcggtcccgacgcatctcgctgcagaggatcaacccccagtactgcacgtacttcaaccgggtcagagagccatcgcctgcttatgcatgggtcaagtgcgagatggaggaagacgaagactgctacgaggcgctgctgaaggcgaacatcatcacgcgcagcggcgtccagtatgaggcgagcagcaggtacacgaggatcagcctcctcaagtcggacgacgacttcgacgtgctcatggagaggcttgaagatcttgtcgatgccgacaagtacgacgattccaacggttcgagctcaatgtagcaacggtaatccacggaagttcggaagcttggggcggtttagatccacctctctaaattttaagaacactctagctcacattgtatgaggtgggctaaattaaaatgcatatgatcagctaggcgctgattgttctgcgaatgtagtggaacagtcaactagaagttgactgtgttcccacaataaaactacctatattggattggcgcaaattatgcggtcagtatatcattccatatttatagtacaacttacagtttgttggattaaaaaaaaaaaaaaaaaa

SEQ ID NO: 276 - protein, 484 aa, Zea mays
MEAAEERPRRRPAGLGVLALLCSSLLLNVLFLAYYYFLSPPSQLADGGSCGLSWALRAARDAEALAATDSCSGHGQVFLDGVVGEDGRPGCECNRCFDGPHCSIRTPNCTADATSGDPLFLEPYWKRHAAASAVLVPGWHRLSYATTDGLFQSVELENHIRRLHRAVGNAVVDGKRLVFGAGSTQLINALVHALSPDANAAAASPPARVVATAPYYPPYRTQTAMFDGREYRWEGTTAAAWANASRNSSSFIEFVTSPNNPDALLRAPVLRGSAVIADHAYYWPHFTHIAAPADEDVMLFTMSKPSGHAGSRLGWALIRDEKVAKRAYEYVQSSIMGASRDTQLRMLEIVKVMLANLHGEEDIFAFGHDVMRTRWRRLSAVVSRSRRISLQRINPQYCTYFNRVREPSPAYAWVKCEMEEDEDCYEALLKANIITRSGVQYEASSRYTRISLLKSDDDFDVLMERLEDLVDADKYDDSNGSSSM

SEQ ID NO: 277 - DNA, 1664 bp, Zea mays
gtgcggagccgcggagggatgggcggcaggagggaggccatagagcgggagctgaagaagcttcgggcagagcgggaggagctcgacgaccggatacggctgctggaatcgcagctcgaggcagggcctgcgggattcaacggtgcggcggcggggaaaggagtaggggacgatgcgtgcggcgggagtggagcgtgccagagccgcgtgggtaacgggtttgctccggacggtagcctcccggcggatatgatctaccggtacagccgccacctccttctcccggacttcggggtcgaaggccagcggaagctatcacagtcgtcgattttagttgttggggctggaggtttgggctctcccctggcattgtatctagcagcttgtggtgtcggtcgcttgggcattgtggatggtgatgatgttgaattgaataatcttcatcgacagataattcataaagaagcatatgttggacaatctaaagtgaagtcagcagctgatgcttgccgggagattaattcctctatcaaagtagtagagtatcaccatactctgaagccatgcaatgctttggaggttgcacggaaatatgatatagttgttgatgcaactgacaaccttcctactaggtatatgatcagcgattgctgtgttttgctgaacaagccacttgtatctggtgcggcattaggcttagaagggcagttgactatttatcatcataatggaagcccatgctatcggtgcctctttccaactccaccacctgtggcagcctgccagagatgctcagacagtggtgtccttggggttgttccgggagtgattggttgcttacaagctctggaggctataaaggttgcaactggtgttggtgagcccctatgcggaagaatgctactatttgatgcactctctgctcgtattagagttgttaaacttcgtggaagctctccagattgcacccattgtggcgaaaactccattttcacagaagaagactttcagaagtttgactatgagagcttcacacagtcaccaatgtctgacaaggcagcaccaagcgtgaacgtactcccagagagcgcgcggatcacttgcagagagtacaagaaactggccgacgatggtgaacctcatctactgttggacgtacggcctgcgcatcacttccagatagcttcgatctctccgtcccacaacatcccgctctccatgctggaagagaagctgcccgcgctcgaagcctcgctgaaggaggcaggagaggggtcagccttggttgtcctgtgtaggagaggcaatgactctcagagagccgtccagcttctccgcgagaagggattcacctccgcgaaggatatcatcggtgggctgcaggcgtggggacgagacgtcgatcctgatttccctgtgtactagcgagatggaaatggatgcactacaccttataacagtttgaatgccgccaaagattctggtggtgttgcaagaacgagaactatggtactatgatttgagtactaattttgccataccgtgtacttgcaaaaaaatatatatatacacaactggtatggacacggtattgtcatggacaatgccatggacaagattaaatttgagatacagaattactttaaaaaaaaaaaaaaaaaaaa

SEQ ID NO: 278 - protein, 468 aa, Zea mays
MGGRREAIERELKKLRAEREELDDRIRLLESQLEAGPAGFNGAAAGKGVGDDACGGSGACQSRVGNGFAPDGSLPADMIYRYSRHLLLPDFGVEGQRKLSQSSILVVGAGGLGSPLALYLAACGVGRLGIVDGDDVELNNLHRQIIHKEAYVGQSKVKSAADACREINSSIKVVEYHHTLKPCNALEVARKYDIVVDATDNLPTRYMISDCCVLLNKPLVSGAALGLEGQLTIYHHNGSPCYRCLFPTPPPVAACQRCSDSGVLGVVPGVIGCLQALEAIKVATGVGEPLCGRMLLFDALSARIRVVKLRGSSPDCTHCGENSIFTEEDFQKFDYESFTQSPMSDKAAPSVNVLPESARITCREYKKLADDGEPHLLLDVRPAHHFQIASISPSHNIPLSMLEEKLPALEASLKEAGEGSALVVLCRRGNDSQRAVQLLREKGFTSAKDIIGGLQAWGRDVDPDFPVY

SEQ ID NO: 279 - DNA, 1440 bp, Zea mays
catccgtacttgtgaccctattccatcaacaccggcctagtataacttgttgccgggtgcctcatccaccaccaccgacgagcaccccctgagcctccgccgtcgagttcgagacgagacggtaccactatggagagtgagcaccacctgttcgagatcgcggccgcccggctcgagcgtagttctgccttcttggacgaggactactcttcatggtctccctgcatacagggctaccactggcgatgcgtctgctccgctgatcccgccgctggtacggcgtccttcaccgtctctcttccctacagcagcacccgcgagcccctcaacgcctcgttcaagctcagcctgctggaccgaggaggcctgccggtgccgtccaggacccgagccaccttgttccagaactgcctgatccagcagatgtggcagtgggagtgtccgggcttcctcaccagggacgacctggagcggcaggagtactacctcgacaacgacggctgccgctgcttccgcgtccgctgcgacatcgccatcaagcccttcgccgcggccacggccggcgacggcgacgccttcgtcgcggcgcccccgtccgacgacctccaccggcacctcggcgacctgctggcgcgcaaggacggcgcggacgtcacgttccagctggtcgacgcgggcggcgagacgttctccgcgcaccggtgcgtgctcgcggcgcggtcgcccgtgttcagagcgcagctgttcggcgagatgatggagagcagcaagggcaccggcgtcgtcataccggttgaggacatggaagcccaggtgttcagcgccctgctggccttcatctacaccgactcgttgccgccggagactggcagcggcgacgacgacgacgacgacgacgatgaagccatggtgcagtatcagcttctgcttgccgccgcggacaggtacggcgtcgacaggatgaagctggtttgccaggagaagctgtgcaagcacatacgcgcggactcggtggccacgatgctggttttagctgaccgacaccattgccctgcgctcaaggaggcgtgcttccgtttcctctcttctagcggcaaccttggctccttcactcagacgacggatggcttcgaggtgctcaacgccagctgccctgctgttctcaaggagctactggccaagcttgccaccgttttgatcttctgagtagccatggccaacggtttccagtttcatacaatgcaggttgctctgctcgtttctcaaaagcgatgcacgtacgtagtaatcttctttgatgaattagtacgtgcaggttttgaacgcatttttccggtggtcgtctgcgaaaacgaaaaatcgctcgaaattcgttgaatttggtaaatctcgagcactttgttacttcaaattgaaaaccccgattttcgttgctctcga

SEQ ID NO: 280 - protein, 358 aa, Zea mays
MESEHHLFEIAAARLERSSAFLDEDYSSWSPCIQGYHWRCVCSADPAAGTASFTVSLPYSSTREPLNASFKLSLLDRGGLPVPSRTRATLFQNCLIQQMWQWECPGFLTRDDLERQEYYLDNDGCRCFRVRCDIAIKPFAAATAGDGDAFVAAPPSDDLHRHLGDLLARKDGADVTFQLVDAGGETFSAHRCVLAARSPVFRAQLFGEMMESSKGTGVVIPVEDMEAQVFSALLAFIYTDSLPPETGSGDDDDDDDDEAMVQYQLLLAAADRYGVDRMKLVCQEKLCKHIRADSVATMLVLADRHHCPALKEACFRFLSSSGNLGSFTQTTDGFEVLNASCPAVLKELLAKLATVLIF

SEQ ID NO: 281 - DNA, 2370 bp, Zea mays
tttatttaaatggagcaacgacaacgatccccacacatgttcatcagctacagctagcccttgagagctctctctcttttttttttttgagagcagatagatgggtgattccactagtacgggcttcgcggcggccctggagctgtggcaagaacaccagctgagcatcctcgtcgtcgcgagcctcgccatccagtggttcctcttcgtcttcgccccgcttcgacagcatcggatcccaggtctgctcaggctctccatctggctggcctacctgggcagcgacgccgtggccatctacgccctcgccaccctcttcaactcccaccggtgcgacaccgacaccggccgccccggcgtggagctgctgtgggcgccaatcctgctggtgcacctgggcggccaggacagcatcacggcctacaacatcgaagacaacgagctatggcggcggcatgtcgtaacagcggtgtctcaggtcgccgctgcgatctatgtgttcgtcaaggcgtggccgaaatccctggtgactactgctcaccaagcagttaaccaagccacccttgacaaggtaaatgccatccaggcccataacgaagagatggaggcttacgggagaatcttcacaccagcacttcttctgttcttctgcgggatcaccaaatgcgtgttcaagccctgggacctcaagagagtcagcgtcaacagcctcgtcgactcttcatcgggctcggaagagaagggcggcgagagtgagatgaattcgcttcaggggtacgtgggagctgcgacacggtatttcgagtcccgcggccatggcagaggagcaggactgcaggaggatgacggcgacgacgacacttgtaaagcaggggaagtttggaagccctacaacctatgcgtggacctggcgcccccttactccggccggctgagctgcctgaaacacctggcgcgcagcccagcggacgaagcccatcgcctggtgaaatccagcctctccgcgacgttccaccagctctacaccaaggaatcgctgaagctgcacgacatctcgcatttcgtcttcacgaacaacgccgccttgaaccgctggaaggtgctcacctcggctcgagggctccggacggtagccgcggccacgctgctcggtgcgatcgcggtgttccactacggcggcggcgccgccgaccaggtcaaggccgacgtcaccgtcacgtacgcgctgctgtggtctgcgtttgtgatggagtacgtcttgcccaccgtgatccaccatacgttcggcagggtacagcggctgttcaccgggcaccggacgtggccggaccaggtcgcgcagtacaacctcatggggtacgtggcacgcagaaggaagcactcgtggctcatggaggtggtaggctggctcggctgcagggacctggtcgaccagctatggaccatggacccgtgcaagggcgcttcgtccagggagatcaccggccttgtccacgcccacgtcgccggagggtggatggagggtcacatagccggcgcggactcgttccgggcgttcaacgactaccggggccagtggactctcaacaacagcagcgtgccttccatggtactgatgagcgtgtcgaggccgttcgacgagagcgtcctcgtctggcacctcgccaccgacttctgcttccacttacttcaggtccagggagacccgtcccgcgccagcgccaccgcccgccgttgcagggagatgtccaactacatggcgtaccttctcttcgtcaagccggagatgctgatgcccggtgcccgacgcagcctgttcagggacgcctgcggcgagctcgtgggcctgctcggggaggaccgtcctggcgcgccgcgggcacggggaaagagaggcctcgcgcacaaggtcgtccagctgctcaagagggacgacgacggcggcgtcctgggctctggaggcgtcggcgtcgttcgccgggcttggtgcgtagccgaggatctcatggactcgcacaggggcagcgaggagaagatgtgggccgtgatccagggcgtgtgggtggagatgctctgcttctcggccagcaggtgcaaaggctacctgcacgccaaaggcttgggaacgggcggggagtacctgtcctacgtatggctcctgctcttgtacatggggatggagaccttggcggagaagatgcagaggacggagctgtatgagggccccactgcagcagcgtcgtccatcagtggccacaatgtttgataccgctcggtctaactctttggaaggagtctaatcctctcaagtttagataaattttaagataataatgtttattgttagatatgtccggccaggccgtagat

SEQ ID NO: 282 - protein, 721 aa, Zea mays
MGDSTSTGFAAALELWQEHQLSILVVASLAIQWFLFVFAPLRQHRIPGLLRLSIWLAYLGSDAVAIYALATLFNSHRCDTDTGRPGVELLWAPILLVHLGGQDSITAYNIEDNELWRRHVVTAVSQVAAAIYVFVKAWPKSLVTTAHQAVNQATLDKVNAIQAHNEEMEAYGRIFTPALLLFFCGITKCVFKPWDLKRVSVNSLVDSSSGSEEKGGESEMNSLQGYVGAATRYFESRGHGRGAGLQEDDGDDDTCKAGEVWKPYNLCVDLAPPYSGRLSCLKHLARSPADEAHRLVKSSLSATFHQLYTKESLKLHDISHFVFTNNAALNRWKVLTSARGLRTVAAATLLGAIAVFHYGGGAADQVKADVTVTYALLWSAFVMEYVLPTVIHHTFGRVQRLFTGHRTWPDQVAQYNLMGYVARRRKHSWLMEVVGWLGCRDLVDQLWTMDPCKGASSREITGLVHAHVAGGWMEGHIAGADSFRAFNDYRGQWTLNNSSVPSMVLMSVSRPFDESVLVWHLATDFCFHLLQVQGDPSRASATARRCREMSNYMAYLLFVKPEMLMPGARRSLFRDACGELVGLLGEDRPGAPRARGKRGLAHKVVQLLKRDDDGGVLGSGGVGVVRRAWCVAEDLMDSHRGSEEKMWAVIQGVWVEMLCFSASRCKGYLHAKGLGTGGEYLSYVWLLLLYMGMETLAEKMQRTELYEGPTAAASSISGHNV

SEQ ID NO: 283 - DNA, 2986 bp, Zea mays
cgtctttcttcctctgctggactcaagtactgcaaattagagcagaaaatcctgtgtaagcaatttccattcgcgctgtcatctcttcctcgatcgaaggtttgctgtgaatttgtagattgcggttttgatgttgtggacaattttgtggctacatacggttgcttcgtccatctgtacttggcttaattaacccaatcatctgctaggtctagatcaagatgagcccatgtctacttcgatcagtttagcctagtcagtgtagaactgtttggcttccgagttcagatatttagctagcatagccaagtgaattttgttcctccagtgggtcatcaaggtgtgcatgtgtcctgggagagagagaagaaaatccagtctgcaggatggatgcaatggcacctgaagaatatgcctcgcaatccaagctactgcaagaattcaccaacgtcccaagcatcgacagtgcttccatcctcaaaaccaacgatgaggacagatccagagcgatgttctccattagccagccagacttactggcgaacaccaacaggaaatacgttttgtattctcatattacgacgagagccggcaccggcaccacctctccggatttccagtggtctcctttccccactgaaacaaccggagtgtccgccaccgttccgtccccttccgggtcgaagctcctcgtagtgcgaaacggggagagaggatgccccaccaagctcgaaatcgtttgtcagtcacatgtggagaaggagatacacgtagcaggttctgtgcacggtcctctctacacggatgaatggtttcatggtgtttcttggaatcaagaagagaccttggtagcatacgtcgctgaagctccagccacaccaagaccagctttcaatcgttccggatacacgagggaagaaggttgttccgagggagactgcagtgcctggaaagggcagggcgtgtgggaggaggactggggtgaaacgtactccaagaaaggaagaccctcactgtttgttcttgacattcccagaggagaagtggtagcggctaaaggtgtcccaacatcgttgagcgttgggcaggttgtttgggctccggaatcaccaggcaggcacaagtatctggttttcgttggatggtcagagcgcaacgggttcttccagaacactgctagaaaactcggcatcaagtactgctccaacaggccatgtgctctctatgcagccccttgccctatccaaggaccagagccgccaccggctacgaccagcagcagtgatggtaaatcaggctccggcggtgcggtggcgcgcaacctaaccccaggcttcagcagtgcattgtttccacggttcagccgggatggaaggcttctggtcttcctgtcttcaaaacaagccgtggacagtggtgcacacaacgcaacggattccctgcatgtgatcaactggccttcggactggaaaatggatgaacaactcgatgttactcaagtggtacctgttgtaatgtgccctgaagacgacgacggcggctgttttccaggcctctactgttcatccgtgctacccgatccttggctctccgacggacgtacagtgatattgacatcttcctggagaagtgccgaagtgatactatcggttgatgtgttaagtggcaaagtggcaagaataactccggaagactcgtgctactcgtggcgtgctcttgcgttagatggcaccaatgttcttgctgtgtcaagtagtcccatcgaccctccttccatcagctatggacgacgtctcgccgtgacaccagctgagggtgaagcacgtagatggacctgggatgaagttactagtccattcatggcatccaacagcaaggttaagtccttgttgctgcatcacagcgtcagcatacttaaaatccctgtccctagcccatctgctgacctctctgacggtggcaagcttccactcgaggccatattcgtgtcctgcagctgcaagggtagctcgcgcagtccaactgttgtggtccttcacggcggcccacactcggtgtccgtatcaagctactcaaaatcctcggcgttccttgcttcgcttggattcaacctgcttgttgtaaactaccgaggcacgccaggttatggagaggaagccttgcagtcgctccctggaaaagttggatcccaggatgttgaggactgccttgcagcgctagacttcgccgtcgaggaagagctggtagatgcgtctagagtagctgttgtcgggatctcgcatggtgggttcctgacaacacatctcatcggtcaggctccggacaggttcgccgtggcagctgctcggaaccctgtctgcaacctgtcgctgatggccggcaccaccgacatcccggactggtgttacgtagtggcctgcggaacccaagcgaagcgatacgcctctgaagcgccttcgcccggccatcttcgtctcttctaccagagatcgccgatcgcccatgtctctaaagtcaaagcgccccttcttatgcttcttggcggagctgaccttcgagtgcctgcttctaatggcctacagtacgcaaggagcctgatagaaagaggaggcgatgtcaaaatcatgatgttcccagaggacatacacgaaatcaatttaccgcggtccgatttcgaaagcttcctcaacattggggtatggttcaagaaacatctgaatgcagtggcatgaagcagatccggcttggtggttcatctaggcgaccatgtacagcattgctactttaagtttgtcaagaattcaaacttttttgtgaaaaaataaatgctcattcatactggtttcatacgacgttctagtgagtgttccaaagacatcgcctagccgtccagtcatatctagctgactagcttgtcttggagaacaatggcgccttgtagcctaacctgacatgtacaatgatgtttaatatagggtctcttaag

SEQ ID NO: 284 - protein, 781 aa, Zea mays
MDAMAPEEYASQSKLLQEFTNVPSIDSASILKTNDEDRSRAMFSISQPDLLANTNRKYVLYSHITTRAGTGTTSPDFQWSPFPTETTGVSATVPSPSGSKLLVVRNGERGCPTKLEIVCQSHVEKEIHVAGSVHGPLYTDEWFHGVSWNQEETLVAYVAEAPATPRPAFNRSGYTREEGCSEGDCSAWKGQGVWEEDWGETYSKKGRPSLFVLDIPRGEVVAAKGVPTSLSVGQVVWAPESPGRHKYLVFVGWSERNGFFQNTARKLGIKYCSNRPCALYAAPCPIQGPEPPPATTSSSDGKSGSGGAVARNLTPGFSSALFPRFSRDGRLLVFLSSKQAVDSGAHNATDSLHVINWPSDWKMDEQLDVTQVVPVVMCPEDDDGGCFPGLYCSSVLPDPWLSDGRTVILTSSWRSAEVILSVDVLSGKVARITPEDSCYSWRALALDGTNVLAVSSSPIDPPSISYGRRLAVTPAEGEARRWTWDEVTSPFMASNSKVKSLLLHHSVSILKIPVPSPSADLSDGGKLPLEAIFVSCSCKGSSRSPTVVVLHGGPHSVSVSSYSKSSAFLASLGFNLLVVNYRGTPGYGEEALQSLPGKVGSQDVEDCLAALDFAVEEELVDASRVAVVGISHGGFLTTHLIGQAPDRFAVAAARNPVCNLSLMAGTTDIPDWCYVVACGTQAKRYASEAPSPGHLRLFYQRSPIAHVSKVKAPLLMLLGGADLRVPASNGLQYARSLIERGGDVKIMMFPEDIHEINLPRSDFESFLNIGVWFKKHLNAVA

SEQ ID NO: 285 - DNA, 2252 bp, Zea mays
ggcgaccgccgcccgggcgccagccactcaaaccctttggtctcctgtcctctcttcgtccaccgcgtcgtcgtctccctccctccgtccccgcacccaccgttatatacaacccccgtcgggactacactcaccaccgcgcctcgaatccatcgctcaactactcgaacccgactcaccggcgcctactcacgcctggctcccgggcccattcgtcgacccgtcgccgggcgaaagcgcgccactaaggtctccaacctccgcccgctgaagcgacggcgccgcatcggaggaactgtagctgttagtccgcctcttctcggcagcgcggggcggagatccgaccggacttgggatcgattccttcccttttctcgattcagggcgctaacagttcctgagggaagcttctggggacatggacatggcattgcccgttgtgaatgccacagcggcggtgctcgcccgtgtctcggctgccttcaatggcccccttgcccgcgcagtcgtcttcggggtccatattgatggtcacttggtcgtggaagggcttcttattgcagtcatcgtgtttcagctctccaggaagagctacaaaccaccaaagaaaccacttactgaaaaggagattgatgagctatgtgatgagtgggagccagagccactatgccctccaatcaaggagggggcccaaattgatactccaacattggaaagtgctgctggaccacatacgattgttgatggtaaagaagttgtgaactttgcatcagcaaactacctcggtttaattggcaacgaaaagattattgattcttgcatcggttcattggagaaatatggtgttggttcttgtggtccacgtggcttttatggaacaattgatgtccatcttgactgtgagtcaaagatagctaaatttttggggactccagactccattctttattcatatgggatttctacaatattcagtgtgatacctgccttctgtaagaaaggagatatcatagtcgctgatgagggtgttcactgggcagtgcaaaatggtctccatctatcaagaagcactgtggtgtacttcaagcacaatgatatggcttcacttgcaagcactttggaaaaacttactcgtggaaataaacgtgctgaaaagattagacgctacattgttgtagaatccatctaccagaattctggccaaattgcccccttggatgagattgtcaggttgaaggagaaatatcgattccgtgttattctggaggagagtcattcttttggggtgcttggcaagtctgggcgtggccttgctgaacattatggagttcctattgaaaaaattgatatcatcactgctggaatgggaaatgcattagctactgatggtggcttttgtacaggaagtgtcagagttgttgatcatcagcgtctaagcagctctgggtatgttttctctgcatctctgccaccttatcttgccagtgctgctgtttctgctgttaactatctcgaggaaaatccctcagttcttgcaaacctaaggagcaatattgctcttttgcataaagaactatcagatactccagggcttgaaatttccagccatgttctgtcacctatcgtcttccttaagctgaagaagtcgactggttctcctaccactgatctagaccttcttgaaactattgctgacaaggccttgaaggaagactcagtttttgttgtgacatcaaagaaatcaaatctggataggtgcaaacttcccattggaatccgcctgtttgtatcagctggccatactgaattagacatctccaggctttcctcatccttgaagagggtttctgcatcggttctttcagattacttttgatccacatcggattcccttaagccgaaagccatccattttctacgcgctttgtactctaggccgtgtgtgtttggtaaatgtacataacctgtacatttctacatgttatgaattgactttgttgcaaaataaaattttgtagaatggttatactcccccgttcttttttatttgttgcgttttagttcaaaaatcaactagcgagcaacaaatattcgagaacggaggtattatgttgaagtatagtgcgtttgtgctgtacatcttgctcttttccatgtagtgatgatttccctgaatccacatacgagcttgttctcttttttatcggaagatgaacggacttacttttaaacaaatacaacacccacctttg

SEQ ID NO: 286 - protein, 485 aa, Zea mays
MDMALPVVNATAAVLARVSAAFNGPLARAVVFGVHIDGHLVVEGLLIAVIVFQLSRKSYKPPKKPLTEKEIDELCDEWEPEPLCPPIKEGAQIDTPTLESAAGPHTIVDGKEVVNFASANYLGLIGNEKIIDSCIGSLEKYGVGSCGPRGFYGTIDVHLDCESKIAKFLGTPDSILYSYGISTIFSVIPAFCKKGDIIVADEGVHWAVQNGLHLSRSTVVYFKHNDMASLASTLEKLTRGNKRAEKIRRYIVVESIYQNSGQIAPLDEIVRLKEKYRFRVILEESHSFGVLGKSGRGLAEHYGVPIEKIDIITAGMGNALATDGGFCTGSVRVVDHQRLSSSGYVFSASLPPYLASAAVSAVNYLEENPSVLANLRSNIALLHKELSDTPGLEISSHVLSPIVFLKLKKSTGSPTTDLDLLETIADKALKEDSVFVVTSKKSNLDRCKLPIGIRLFVSAGHTELDISRLSSSLKRVSASVLSDYF

SEQ ID NO: 287 - DNA, 2274 bp, Zea mays
ggcgcccgctaggctccggcacgccgccacgtcacccgcctggggctggcaccgggcacccgccgaggtatttatacgagcgccccgggcgagccagcgacccgcatcgtcttcctctgttttgccagggccaaccaagccaacgggtcgagttgaaccaacgccattacgagagaagaggggttggggaggtagacgagtggcgtagggaactcggtcgtggggcggtagagtgagcgagtgagagagaggcagggctgtcacgagcgtgggcaggcgatcgcgggagcgatgacgacggcggccggcatgccggggttgccggtgggctcggccgccgcggctggggttcccgcggcgcccgaggtggcggccagggacgcggtgatcggctggttccgcggcgagttcgcggccgcgaacgccatgattgacgcgctgtgcggccacctggcgcagatcggcggcggcgggcccgagtacgatcccgtcttcgccgcgatccaccgccgccgcgccaactggttccccgtcctccacatgcagaagttctaccccgtcgcggacgtcgccgccgagctgcgccgagttgcggacgcccgcgccgccgcagggtcctgctgctactccgaggaggccgcgtccacggtgatccacgagcccatggaagaggctgaggctgaggctgaggctgagcccgaacccgagcaggagcacgagcaggatccggcaccggcggccgagctggctgacggcgccgtggagtaccacgagccggacgtggaagttgattcatcgggagattcgtcggagcggaagcccccctccaccgaagatgacaccgtcgcagacggacatcatactgatcaaggatctcaaggggaacacagcctaccagagagctatcccatctgctctgaccacgaggagtgcattgcccgtcctgagaggatcaagatccagaaaggtttcgtggccaaggaatccgtgaaggggcacatggttaatgtcgtgaaaggcttgaagatatatgaagatgcgtttacgacatcagagatcatgaaagttgcagatttcatcaacgaaattcgtcaagctggcagaaatggagaactttcaggtgagactttcatattcttcaacaagcagatcaaaggaaacaagagggagatcatacagcttggtgtaccgttatttcaacctaccacagaggatgctaattgtcacacagaaccaatcccccttgtcctgcaggctgtcattgaccaccttgttctttggcgtttaataccagaaagcaggaaaccaaacagtgtcatcatcaacttcttcgatgaggatgaacattcgcagccctacttcaagcctccccatctggacaaccccatttgcactcttctgctgtctgaaactacgatggcatttggcaggtcacttgtcactgacagcaacggcaactacaagggacctctcacactctcactaaagcaagggtccctattggtgatgcgtgggaacagtgccgacatggcgcgccacgtggtgtgcacgtcgtccaaccggcgcgtgagcatcacgtttgcaagggtgaggccatcgacgccggtggatctgagcccactcccgtcccccaccaaggccttgacgccctggcagccgcagccagccacggcctcccaggtgccggcgcccgcgtgcatgacgcagaagcccccggtcagcggcgccatcatcggttatgccccgaccccgcagaccgtgctggcgcccgcggcctggggcatggccatgcgagcgcccgtcatgatggtggccgcagcgcctgcgaggcccatggtgatggcctcgttgggcaccggaggcggcaacatcagcaagcggatgagccgcagcggcaccggtgtgttcctgccgtggacggtcgggccgaagcggtacaacaagcaccttccgccgcgcatccagaagcgccggttctctgcgatgatgtcgcccatcgaggcgcagggctgaggacctgcccgacttcacgtcgccgtcgaacctgtgtttttttttttccttgagggctttcggtccgcctgtaatttagccgggtttgtgacttgtgacaatgtgagtgagtagcggtttagcggagttcagaaccggtagaggagtacgagcgtagggataggtgaaggcagaatcagggcagggttttccttttgttttcatcctgtccccctattttccgttccgagaaaaacttatggatgttgttgtcaaaaaaaa

SEQ ID NO: 288 - protein, 573 aa, Zea mays
MTTAAGMPGLPVGSAAAAGVPAAPEVAARDAVIGWFRGEFAAANAMIDALCGHLAQIGGGGPEYDPVFAAIHRRRANWFPVLHMQKFYPVADVAAELRRVADARAAAGSCCYSEEAASTVIHEPMEEAEAEAEAEPEPEQEHEQDPAPAAELADGAVEYHEPDVEVDSSGDSSERKPPSTEDDTVADGHHTDQGSQGEHSLPESYPICSDHEECIARPERIKIQKGFVAKESVKGHMVNVVKGLKIYEDAFTTSEIMKVADFINEIRQAGRNGELSGETFIFFNKQIKGNKREIIQLGVPLFQPTTEDANCHTEPIPLVLQAVIDHLVLWRLIPESRKPNSVIINFFDEDEHSQPYFKPPHLDNPICTLLLSETTMAFGRSLVTDSNGNYKGPLTLSLKQGSLLVMRGNSADMARHVVCTSSNRRVSITFARVRPSTPVDLSPLPSPTKALTPWQPQPATASQVPAPACMTQKPPVSGAIIGYAPTPQTVLAPAAWGMAMRAPVMMVAAAPARPMVMASLGTGGGNISKRMSRSGTGVFLPWTVGPKRYNKHLPPRIQKRRFSAMMSPIEAQG

SEQ ID NO: 289 - DNA, 923 bp, Zea mays
ggcaggattaggcagggcagcgccgcgccggccggaccgcccgcccgcccgcccgtccacgagccacggactttcggccatgggggacgctggcgctgacgcctcctcctcgccgccgccgccgtccgggtccttctcctacttcgccgtcttccgcaactaccccctcgtcgccgccctgctcggcttcgccgtcgcccagtccatcaagttcttcgtcacacggtacaaggagaacagatgggatcccaagcggcttatcggctcgggtggcatgccgtcatcacattccgccacggttacagcactagcagtagcaattggattccaggatggctttagctgctccctctttgcaacagcaactatatttgcaagcgtggtaatgtatgatgcttctggtatcagactgcatgctggaaagcaagcagaggtattgaatcaaatagtttgtgaacttccttctgaacaccccttgtctgagacaagaccactgcgagaacttttaggccatacaccaactcaggtggttgctggtgcattgcttgggtgtacaatagccacagcaggacaattattcctttgaactacgaaggtgcggcagaaatgttgtagcatttgtatcgcagggacttgagaagaagtttctccagtgttctgctactttaggtattggtaagctttgcatgttggtgctgtagtgttgttgaatgttgtatgttctgatggaatgtggttatatgtcaaaaagttctcgcagtggtcttgtctcagacaaggggtgttcagaaggaagttcacaaactatttgattcaatacctctgcttgctttccagcatgcagtctgataccagaagcatcatacattgatgaaatctaaaatgtgattaaaacagctgcaaaaaaaaaaaaaaaaaaaaaa

SEQ ID NO: 290 - protein, 168 aa, Zea mays
MGDAGADASSSPPPPSGSFSYFAVFRNYPLVAALLGFAVAQSIKFFVTRYKENRWDPKRLIGSGGMPSSHSATVTALAVAIGFQDGFSCSLFATATIFASVVMYDASGIRLHAGKQAEVLNQIVCELPSEHPLSETRPLRELLGHTPTQVVAGALLGCTIATAGQLFL

SEQ ID NO: 291 - DNA, 2030 bp, Zea mays
cttccgttcccttcccacgaaaaccggagagggagtgagaagaagcaacaagaagcggagagccaacgcgcaacgcaacgccctgagatggcggcgccggcgccggcgccgaagcaggaggagctgcagccgcacgccgtcagggaccagctgccctccgtctcctactgcctgacaagcccgcccccatggccggaggccgtcctcctcggcttccagcactacctcgtcatgctcggcaccaccgtcatcatccccaccgcgctcgtgccccagatgggcggcggcaatgaggagaaggcgcgggtggtgcagacgctgctgttcgtggccgggatcaacacgctggtccagagcttcctcggcacgcgcctccccgccgtcatgggggcctcctacaccttcgtcgcgcccaccatctccatcgtcctcgccggccgctacagcggcatcgccgatccccacgagaaattcgtgcgcatcatgcgggggacgcaaggcgcgttcattgtggcctccacgctccaaatcatcatgggcttcagtggcctttggcgcattgtcgtcaggctgctcagtccgctgtctgctgctcccttggtcgctctcgtcggatttggactctatgagctagggtttccaagtgttgccaaatgtgtggagattggtcttcctcagattttactgctggtggcgctttctcagtacataccacatgcggcccccttgctgagtactgcctttgagcggtttgctgtcataatgtccattgccctcatctggctttacgccttcttcctgacggttggcggtgcctacaagaatgctgcccccaaaacccaattccactgccgtactgatcgatctgggcttgttgggggcgctccatggataagtgtaccctatccgtttcagtggggagcaccaacctttgatgccggtgaagcttttgctatgatggcagcttcttttgttgcccttgtggagtccactggtgcgtttatcgccgtctcacggtacgccagtgcaacaccatgccctccttccgtcatgagccgtggcattgggtggcagggagttggcattttgctaggtggcatatttggaacagctaatggcacctctgtgtctgtcgaaaatgctgggttgctcggtttgacacgcgttggtagtagacgtgttgtgcagatttctgccgggtttatgatattcttctccatccttggaaaattcggagccgttttcgcatcaattcctggcccgattatcgcggctatatactgtcttctcttcgcttatgttggtacggcgggtgttggtttcctgcagttctgcaacctgaacagcttccgaacaaaattcatcctggggttctctttgtttatgggtttgtcggtgccacagtatttcaacgagtacacttccgtcgcaggctttggcccggtacacacgcgtgcaagatggttcaacgatatggtcaacgtggtattctcctcgaaggcgttcgtcggcggggctgtggcgtatttcctggacaacaccttgcaacggcgagatggcgccgtgaggaaggaccgggggcaccatttctgggacaggttcaggtccttcaagacagacccgcgcagcgaggagttctactccctcccattcaacctcaacaagttcttcccgtccttctgatcctgatggctggtaactgggcgactgaaaatgctgtccggtcaggtggttgtgaattatgattttggcaaaatgccacgcccaaacggctgtttcctctcctgcttctgttgtaaccactcgttgagttctgaatcttgtagagctcagcctgaactatccagaagtagtggaggagaaattggcaggtatttttggatgtaaattgggtctgtgttctcccatagatcgataaggtgggaagagaactttctgtagattacacaatccagtgctatactaatgctagtgcaggggcccccgttgcagatttagaaaaaaaaaaaaaaaaaaaaaaaaaaaaaaaa

SEQ ID NO: 292 - protein, 531 aa, Zea mays
MAAPAPAPKQEELQPHAVRDQLPSVSYCLTSPPPWPEAVLLGFQHYLVMLGTTVIIPTALVPQMGGGNEEKARVVQTLLFVAGINTLVQSFLGTRLPAVMGASYTFVAPTISIVLAGRYSGIADPHEKFVRIMRGTQGAFIVASTLQIIMGFSGLWRIVVRLLSPLSAAPLVALVGFGLYELGFPSVAKCVEIGLPQILLLVALSQYIPHAAPLLSTAFERFAVIMSIALIWLYAFFLTVGGAYKNAAPKTQFHCRTDRSGLVGGAPWISVPYPFQWGAPTFDAGEAFAMMAASFVALVESTGAFIAVSRYASATPCPPSVMSRGIGWQGVGILLGGIFGTANGTSVSVENAGLLGLTRVGSRRVVQISAGFMIFFSILGKFGAVFASIPGPIIAAIYCLLFAYVGTAGVGFLQFCNLNSFRTKFILGFSLFMGLSVPQYFNEYTSVAGFGPVHTRARWFNDMVNVVFSSKAFVGGAVAYFLDNTLQRRDGAVRKDRGHHFWDRFRSFKTDPRSEEFYSLPFNLNKFFPSF

SEQ ID NO: 293 - DNA, 2496 bp, Zea mays
ggaagctgcggccgacggccgagctcttgccgtccctacccacccctctcggctctcgccctcctctctgtctttcgctccgtccagccgccgcgtaaaatccgcggaaccagatgcccttatccgccctctgatcgaatccggccagaaaggccggttctttgtcgtcgtcctcggcatcgccggcgaccttgatggcactggaggcgggtagcagcggcggcggcgggaggggatggggtggcaggttccgaagcctgatgcggcggaagcaggtggactccgatcgggtccgcgccgagggccagccgcagctcgccaaggagctcaacgtgccggagctggtcgcgatcggggttggttccacagttggagcaggagtatatgttcttgtgggaataattgctagggagcacgctggtccagcattgacaatttcatttctgatagctggaatagcagccgcgctttcagctttctgttatgctgagcttgctagtcgttgcccctctgctggaagtgcctaccattattcatacatctgtgttggagaaggtgttgcctggttgattggctgggctctagtgctggaatatactattggtggatctgctgttgcccgtggtatatctccaaacttagccttgttttttggaggacaggatagtctgccatggattttagcacgccatcagcttccatggtttggtatcattattgatccctgtgcagctgctcttgtttgtgttgtgactgttttactctgcatgggaattaaagagagttcatttgcacaaggagttgtaacagttctgaatgcttttgtaatgatatttgttattgtagctggtagttatattggcttccaaataggatgggtcggctacaaggtttctgatgggtatttcccatatggagtaaatggaatgcttgctggatcagcaactgttttctttgcatacataggctttgatacagtcgctagtacagctgaagaggtaaagaatccacagagagatctgccattgggaatcggagtagcattggctatttgttgtgcattgtatatggctgtttctgttgttattgttgggctggtaccatattttgccatggacccagatactcctatttcatctgcctttgcaaaacatggaatgcaatgggccatgtacgttgtgacaactggtgctgttcttgcactctgctcgaacttgatgggctcacttcttccacagcctagaatacttatggccatggcacgagatggcctgttgccatccttcttctctgatgttaacaagcaaactcaagtacctgttaagagcacaattgtgacaggcatctgtgcagctgctctggcttttacaatggatgtctcacagttagcaggaatggtcagtgtaggcacactccttgcattcaccgtagttgctgtttcgatcttgatactcagatatgtccctccagatgaggtccctttgccaccctctctgcaagaatcattccgtttgaaccaggaatgcgatgaggaaagggacagggctcttcttggagttgggaactgtaccttgtctcagacaaaggatgtgattgtggtagtagaatcagttaaggaccctctcattgatataccgctgcataaaggcaagatggatgagacaaagcgccgaaagatagcctctttaagcataggatctgtgtgtataggggttctgatcctcacatcttcagcctctgccacatggttgccttttctcccgatatgtattggctgcatcattggagttgtgctccttctggctggcctcagtttgctctcctggatcgaccaagatgctggcaggcactcttttggtcattctggaggattcacatgcccttttgttccagtgctgccagttttgtgcatcctgataaatacgtatctgttgataaacctgggtggtgacacatggatgagagttggcatatggctgctgatgggtgttctcctgtacattttctacggacgaacccacagctccctaacagatgtcgtctacgttccagtagcgcaggctgatgagatgtacaggagttcatcaggatatgtatcatagaaaagaacagccgcagttacttcaaggtggttggtcattcagttgtagataattggttatcaaccaggaaagaggggaattggctgttatttctttcatgcttggccaacaagatctcgtggatgcaactttgcaagatatatatgatgttcacgagcctggtcaatttacacattgtttgttggagtgtgcgtagatgtggtgtatataaacccagctgggtggaatgatgtggtacataatttatgcaattcatgtaaaagccctttctacctttctactgaaatgggagagcatttaaagggcatattgaaacagtacatgaatggcaagagaagctaccttttttttaaaaaaaaaaaaaaaaaaaaaaaaaaaaaaaaaaaaaaaaaaa

SEQ ID NO: 294 - protein, 635 aa, Zea mays
MALEAGSSGGGGRGWGGRFRSLMRRKQVDSDRVRAEGQPQLAKELNVPELVAIGVGSTVGAGVYVLVGIIAREHAGPALTISFLIAGIAAALSAFCYAELASRCPSAGSAYHYSYICVGEGVAWLIGWALVLEYTIGGSAVARGISPNLALFFGGQDSLPWILARHQLPWFGIIIDPCAAALVCVVTVLLCMGIKESSFAQGVVTVLNAFVMIFVIVAGSYIGFQIGWVGYKVSDGYFPYGVNGMLAGSATVFFAYIGFDTVASTAEEVKNPQRDLPLGIGVALAICCALYMAVSVVIVGLVPYFAMDPDTPISSAFAKHGMQWAMYVVTTGAVLALCSNLMGSLLPQPRILMAMARDGLLPSFFSDVNKQTQVPVKSTIVTGICAAALAFTMDVSQLAGMVSVGTLLAFTVVAVSILILRYVPPDEVPLPPSLQESFRLNQECDEERDRALLGVGNCTLSQTKDVIVVVESVKDPLIDIPLHKGKMDETKRRKIASLSIGSVCIGVLILTSSASATWLPFLPICIGCIIGVVLLLAGLSLLSWIDQDAGRHSFGHSGGFTCPFVPVLPVLCILINTYLLINLGGDTWMRVGIWLLMGVLLYIFYGRTHSSLTDVVYVPVAQADEMYRSSSGYVS

SEQ ID NO: 295 - DNA, 785 bp, Zea mays
cgctagctcgctcgctctccttgcaactccagtgctgctcactgccactgccagcagatcgagctgctccgtctcacaaaccctcttgctttgctgctgcacctgcaagtctgcaaccgcgcacacagagatgtcgacgacggtgagccgtgcgtccctcgaccagaagctcgccctcgccaagcgttgctcccgagaggcgaccctcgccggagccaaggcggcagcggtggcgactatcgcctccgcgatccccaccctggccagcgtgcggatgctgccatgggccaaggccaacatcaaccccaccggccaggcgctcatcgtctccacggtggctgggatggcctacttcatcgccgccgacaagaagatcctgtcgctggcgaggcgccactcgttcgagcaagcccctgagcacctcaagaacacctccttccagggcaccggccgtccccacccagccttcttcaggccgtgagacgagacctccgtccagagctagctacctacctctttttccagtttgccaatgcaagcaccaaatgcccaccgatgcatgcctgaataaactactgtaattgcgaggctgctgaacgtcgatgcgctagtataactactactactacgaggctagctgcgcgctgaacacagcgctgtaaagtagtgttggtgtgctaaattcagaatgtgtaagtttaatttatgttattaccagttaaccaactttgtgtgtgctattttcttgtaaaaaaataaagtggttagtggccaaaaaaaaaaaa

SEQ ID NO: 296 - protein, 116 aa, Zea mays
MSTTVSRASLDQKLALAKRCSREATLAGAKAAAVATIASAIPTLASVRMLPWAKANINPTGQALIVSTVAGMAYFIAADKKILSLARRHSFEQAPEHLKNTSFQGTGRPHPAFFRP

SEQ ID NO: 297 - DNA, 1583 bp, Zea mays
agtgacttcggtacagacgacaaactttctccacacataccgcgccactccgccactcactgtgctgacggatggggtggtgctccccgtccacttcccggcagcttctctccacgacctcactcttcaccttcggcgcgggtctccttaccttcggcatccacctctcctacgtccacatcgagccccagcgcgctcgcacgctcgctcgggaccaattcatccgtgactacctccgcaagaagcacgacaagtagcccgccttctgcggtccccaggtgattgcttggtagtcggagacgatggccctggtcccatcgaggtccgacagcgaggccttgatcccggaggtggagatgaatgccggcgccgaccagaccgcaacaacggcgcgggtcaccgtcgttcaggcgtcgtccgtgttctacgacacccctgcgactctcgataaagcggagaaattggtagcagaagcagctgggtatggttcacagttggttttgtttccggaagtctttgttggtggctacccacatggatctacctttggactggttgtcggcaatcgcactgccaagggaaaggaagactttcagaagcatcacgcatctgccatagatgtgcctggtccagaagtctcccgcttatctgcattagctggaaaatataaggtgtttctggtgataggggtggttgagagggcaggatatacactttacaacacggtgctctccttcgatccactgggaaaatacctagggaagcaccgcaaggtcatgcctactgcactagaacgtgtattctgggggtttggagatggatctacaatacctgtctacgatactccgattggaaaaatgggtgctctcatttgctgggaaaacagaatgccacttctcaggacggccatgtatgccaaaggtattgagatatattgtgctcccacggttgattgcatgccaacttggctgtcttctatgacacatatcgcccttgaagggggatgctttgtgctgtcagcgtgccagttctgtcgtagaaagaactaccctccccctcccgagtacacattttgtggcctagaggaagagccatccccggaatccgttgtttgttctggagggagtgtcatcatctcaccattgggaacagtgttggcgggtcccaactacgaaagtgaggcccttctcactgctgacctggaccttggagagattgttcgagccaagtttgattttgacgtggtgggccactactcgcgacctgaggtgctgagtttagtggtgaagagcgatccaaagcccgccgtctctttcatctcagccgctggtagggacgatgactatgtgcagacctaatgacaaacatatctttggtctttagcttccttatacggcaatcgcatgcatctgtataattgtgggtttccggaacgttgcacgttccgtcagaataataataaactgttatgtacaataaaatagtaacaataaggctttgttcggttattcccattatacatggattggacgagattggaaaaaatttaaaaaaaaaaaaaaaaaaaaaaaaaaaaaaaaaaa

SEQ ID NO: 298 - protein, 351 aa, Zea mays
MALVPSRSDSEALIPEVEMNAGADQTATTARVTVVQASSVFYDTPATLDKAEKLVAEAAGYGSQLVLFPEVFVGGYPHGSTFGLVVGNRTAKGKEDFQKHHASAIDVPGPEVSRLSALAGKYKVFLVIGVVERAGYTLYNTVLSFDPLGKYLGKHRKVMPTALERVFWGFGDGSTIPVYDTPIGKMGALICWENRMPLLRTAMYAKGIEIYCAPTVDCMPTWLSSMTHIALEGGCFVLSACQFCRRKNYPPPPEYTFCGLEEEPSPESVVCSGGSVIISPLGTVLAGPNYESEALLTADLDLGEIVRAKFDFDVVGHYSRPEVLSLVVKSDPKPAVSFISAAGRDDDYVQT

SEQ ID NO: 299 - DNA, 1553 bp, Zea mays
gcgacgtgaatccaagcgtgcaagcaagcggcggtaatggcggcggctctgcaagccacgccgctcaaaaccctatccatctcccgccggcgcgtcggcggcgcgggggcgcggccgcgtccgatggcggcgagcttccgatgctccgcggcggcgaggagctacaatatcacgctcctccccggagacggcatcggccctgaggtggtcgccgtcgccaaggacgtgctgtccctcgccggcgccctcgaaggcgtcgagctccggttccaggagaagcttgtgggtggctcggccctggacgccaccggcgtgccgctccccgacgagacactcgacgcggccaagggttccgacgccgtcctcctcggcgccattggaggctataagtgggataacaatgagaagcacctcaagcctgagaccgggctgctgcagctccgtgccggacttggggtctttgccaatctgcgaccagctgcagtattgccgcagttggtagatgcatccactctgaagaaagaggtagctgaaggtgttgacatcatggttgtcagagagcttactggaggcatctacttcggcaaacccaggggttttggaacaaatgacaatggagatgacattgggttcaacacagaagtttattcagcttctgagattgatcgtatcgcacgagtcgcatttgaggttgctcgcaagagaagagggagactatgctcggttgacaaagcaaatgtcttggaggcatctatgctttggaggaaaagggtgactgcactagcttcggaattccctgatattgagctctcacacatgtatgttgataatgctgcgatgcagcttgttaggaatcctaagcagtttgacacaattgtcacaaacaatatttttggtgacatattatctgatgaagcatcaatgattacgggaagtattggaatgctcccatctgccagtgttggtgaatcgggacctggtctttttgaacctattcatggctctgcccctgatattgctggacaggacaaggccaatccattggctacaattcttagtgcagcgatgctattgagatatggcctaggagaagaaaatgctgcgaacagaattgaagctgcagttactgaaacactgaaccatgggttccgaactggggacatatattctcctggaacaacattggttggatgcaagcggatgggggaagaagtcctgaagacagtgaactcactgaaggaagtggctgctgtaaactgatgcatgttggtacttaatttataaccctacaggatgagatggttgaaagggacttgcattttattagaagttgagcctggtgaaagagagcactgcgtctggttttgaatcgcaactgtagcggctgaaccgacggtcttttttcatttctggtgtttgttggccttcctgtaactcaattttgtacaaggaaggataagcatatgtatgataaaatgggatagtttatgccagttgaataaaatatgttctataacttttattcaaaaaaaaaaaaaaaaaaaaaaaaaaaa

SEQ ID NO: 300 - protein, 407 aa, Zea mays
MAAALQATPLKTLSISRRRVGGAGARPRPMAASFRCSAAARSYNITLLPGDGIGPEVVAVAKDVLSLAGALEGVELRFQEKLVGGSALDATGVPLPDETLDAAKGSDAVLLGAIGGYKWDNNEKHLKPETGLLQLRAGLGVFANLRPAAVLPQLVDASTLKKEVAEGVDIMVVRELTGGIYFGKPRGFGTNDNGDDIGFNTEVYSASEIDRIARVAFEVARKRRGRLCSVDKANVLEASMLWRKRVTALASEFPDIELSHMYVDNAAMQLVRNPKQFDTIVTNNIFGDILSDEASMITGSIGMLPSASVGESGPGLFEPIHGSAPDIAGQDKANPLATILSAAMLLRYGLGEENAANRIEAAVTETLNHGFRTGDIYSPGTTLVGCKRMGEEVLKTVNSLKEVAAVN

SEQ ID NO: 301 - DNA, 1868 bp, Zea mays
gcccaaggcgcgtcatgcctgccgcctttgcccgcctctgatgctcgcaaagggccagcattctctcgtccactcaacgacagcgagccctatcccctcagcaaaagccagatgcctgttgccgtcgcggccactggatgccaagtactttttatatacgccgtccgcgcccacgacccccgagacccgcctcccctcgtcgtctcgtctcgcctcgcgtcgtctgcgctcgcggctcgtcacaggtgaggtctcggcgggagaggggcggcggccggtccgtgtccgtgtccgtcgacggttggttcgggaatggcgcaggcggtggtgccggcgatgcagtgccgggtcggagtgaaggcggcggcggggagggtgtggagcgccggcaggactaggaccggccgcggcggcgcctcgccggggttcaaggtcatggccgtcagcacgggcagcaccggggtggtgccgcgcctcgagcagctgctcaacatggacaccacgccctacaccgacaaggtcatcgccgagtacatctgggtcggaggatctggaatcgacatcagaagcaaatcaaggacgatttcgaaacccgtggaggatccctcagaactaccaaaatggaactacgatggatctagcacaggacaagccccgggagaagacagtgaagtcattctatacccccaggctatcttcaaggacccattccgaggtggcaacaacgttttggttatctgtgacacctacacgccacagggggaaccccttccaactaacaaacgccacagggctgcgcaaattttcagcgacccaaaggtcgctgaacaagtgccatggtttggcatagagcaagagtacactttgctccagaaagatgtaaattggcctcttggttggcctgttggaggcttccctggtccccagggtccatactactgtgccgtaggagccgacaaatcatttggccgtgacatatcagatgctcactacaaggcatgcctctacgctggaatcaacattagtggaacaaacggggaggtcatgcctggtcagtgggagtaccaagttggacctagtgttggtattgaagcaggagatcacatatggatttcgagatacattctcgagagaatcacagagcaagctggggttgtccttacccttgatccaaaaccaattcagggtgactggaacggagctggctgccacacaaattacagcacaaagactatgcgcgaagacggcgggtttgaagagatcaagagagcaatcctgaacctttctctgcgccatgatctgcatattagtgcatacggagaaggaaatgaaagaagactgactgggaaacatgagactgcgagcatcggaacgttctcatggggtgtggcaaaccgcggctgctctatccgtgtggggcgcgataccgaggcaaaagggaaaggttacctggaagaccgtcggccggcatcaaacatggacccgtacattgtgacggggctactggccgagaccacgatcctctggcagccatccctcgaggcggaggctcttgccgccaagaagctggcgctgaaggtgtgaagcagctgaaggatggttcaggcaccaatataaaccggtccgcgacaagattgatctttgtgtccatggcgtgggtcttgcgactctctgctcggcggtgccactctgtacaaaatcacggctgtctttgattcatcggatattcggatacgtttgtttgttactttttgcttggacacccaccatgtttggaacttttttgggctccgtttgggggctgaacgatggtcagtggaaattttaaaaattaatcgtcaaaaaaaaaaaaaaaaaaaaaaaaaaaa

SEQ ID NO: 302 - protein, 423 aa, Zea mays; identical to SEQ ID NO: 138

SEQ ID NO: 303 - DNA, 2030 bp, Zea mays
agccgccctacctattccttctccccgccgtcgagctgcccaacccagagcaccagcagccctcacctccttcctctcggccggtccttccaacgagcccgctggtcttggagccgccgccggtctcgttctggacgaacgttcaaggagattgcatttgtggatgctctaatggagtcgaaaggtggcaagaagtctagtagtagtagtagtaatttcatgtacgaagctccccttggctacaagatcgaggacgttcgcccagccggaggaatcaagaagttccagactgctgcttattccaactgcgtccgccagccatcctgatatcgcctcacatgcaattcgcggtagagtaggattttaattcagttttcctcttgtgtcggtagttttccgttggctctggctgccttcctctgcttctgagattccaacttgtcttgcccatctctccttttcctctctcatcctctctttcttgcaacacgtcatccagtggcgatgtcttcagcagattcttgtggctcttctcctgcctcccctattggctttgagggctatgagaagcgcctcgagatcacgttctctgacgcgcctgtctttgaggacccttgtggtcgtggcctgcgcgccctctcccgtgagcagatcgactcgtttctggatctcgcacggtgcaccatagtgtcacagctctccaacgagagcttcgactcatatgttctgtccgagtccagcctctttgtgtatccccacaaggttgttctgaagacctgtgggacgacgaagctgctgctcgccattcctcgcatccttgagcttgctgcagggctgtcactgcctcttctttctgcgaagtactctcgtgggaccttcatcttccccggcgcgcagcccgcgccacaccgcagcttctcggaggaggtatctgtgctgaacgctttctttggtaacctcaagtccggtggcaatgcctacctgatcggtgaaccgttcaagcccaacaagaagtggcatgtctactacgccacagaggagcctgagcgtcctatggtgacgcttgagatgtgcatgacagagcttgacgttaagaaagctgctgtgttcttcaagaactccactggtggcagctgcacttcagctaaagagatgacgaagctctcggggattcatgagatcattcccgagatggagatctgtgacttcgagttcgacccctgtgggtactcgatgaatggcgtcttcgggcctgcagcctccaccatccatgtgacacccgaggaaggtttcagctacgcaagctacgaagctatgaacttcgaccccagctcactggtctacagcgatgtgatcaggagggtcctggcaggcttctctccttcggacttctcggtcgcagttaccatctttggtggccgtgggttcgccaaatcatgggcgacgggtgcagacatcgattcctacatgtgcggtgatcctgtagagcaagagcttcctggtggcggtctgctgatgtaccagagctttactgctgttccctctggctctgtatcgccgaggtcgaccttgcagacggatggctggagcagcgatggaatggagatggcctcaaatgacgagatgtgtattggctgctggaatgcggtgaagaaggtggtgaagaaagatttggatgcttaaagatttggataacttaggtggttcttcacctaagttatgaagaagtctgagacctctgtctctctgttcttttggtttcagttaagcagttagctgggctaccggcaatttgtttgcttaatatttttcctgttcaataagtactctggatggcttgctgcgtctgccatagtgagctgcatattgttgtttagtcatattgtttctgctgccgatgcccttgtggggagaatgatcttgtaacagacttgcctattcccgcaatatattggaaattttggttaataaaaaaaaaaaaaaaaaaaaaaaaaaaaaaaaaaaaaaaaaaaaaaaaaaaaaaaaaaaaa

SEQ ID NO: 304 - protein, 392 aa, Zea mays
MSSADSCGSSPASPIGFEGYEKRLEITFSDAPVFEDPCGRGLRALSREQIDSFLDLARCTIVSQLSNESFDSYVLSESSLFVYPHKVVLKTCGTTKLLLAIPRILELAAGLSLPLLSAKYSRGTFIFPGAQPAPHRSFSEEVSVLNAFFGNLKSGGNAYLIGEPFKPNKKWHVYYATEEPERPMVTLEMCMTELDVKKAAVFFKNSTGGSCTSAKEMTKLSGIHEIIPEMEICDFEFDPCGYSMNGVFGPAASTIHVTPEEGFSYASYEAMNFDPSSLVYSDVIRRVLAGFSPSDFSVAVTIFGGRGFAKSWATGADIDSYMCGDPVEQELPGGGLLMYQSFTAVPSGSVSPRSTLQTDGWSSDGMEMASNDEMCIGCWNAVKKVVKKDLDA

SEQ ID NO: 305 - DNA, 786 bp, Zea mays
cacggctccacccctataaatgctggccatgaggcaccacggtttcttcaattcatccagcacaagtcatatctagctagtagctccctgaaaagttcactagagaagcatttgagggaggagccatgtctgaggagaagcaccaccaccacctgttccaccaccgcaaggcagaggaggaggaaggcgcctccggcgaggtcgactacgagaagaaggagaagcaccacaagcacatggagcagctcggccagctcggcgccatcgccgccggcgcgtacgctctgcacgagaagcacaaggccaagaaggacccggagaacgagcacggccaccgggtcaaggaggaggtggccgccgtcgccgccgtgggctccgccgggttcgccttccacgagcatcacgagaagaaggacgccaagaagcacgcccacaactgatccgtcgcaggctgcctcagccgaagcagcagcacatcgtcgcggttgctgtttcatctgttctcccagcctcgtcttcgtctactgtgtgccgggcaggccttgatttgaggctttgagctaccgatatttgcacggacgtaggaactgtgttggtcctcggcgttcttgtatcaagatcaaatcaggccttcaataagtgtgtgtgtgtgcatatatcttttttttaaaatttatctctttttttttgtatcgagagatgttctgaataatgtgaatttacgtgtgtttatataaacgaatttaagaaaaaaaaaaaaaaaaaaaaaaaaaaaaaaaaaaaaaa

SEQ ID NO: 306 - protein, 104 aa, Zea mays
MSEEKHHHHLFHHRKAEEEEGASGEVDYEKKEKHHKHMEQLGQLGAIAAGAYALHEKHKAKKDPENEHGHRVKEEVAAVAAVGSAGFAFHEHHEKKDAKKHAHN

SEQ ID NO: 307 - DNA, 1875 bp, Zea mays
gcacgcgttcttctcccgtccaagaccacacgcgcacagaaaaaagcatagctggtcagtggtcctggtcagctgctcccgtacaaaaagcgcaccacaagcggcggccaagccgtccgctgccccccgcatcgccatggctctcgccgtgcgcacgccccgcttccagcctcgaccggcctccatttctgcgcccgcaacacccgcctcgaattccctcgccgccgccgccgccgcgaacgcgaggccccgcacctgcgccggcgccgccgtccgcgcttcgcccttcaccgaggccacctcctcctcgcgctacctccgtgacgcctggtcctacgccaccgattgctcctccaactccgcatcccgttcctccgatgccgccgctgcggcggcggcgctgggccgccgggacgacgagatcgcactgcagctgccggagctgcagaggctcctggacgcgctgagggcgtccagaaggaggggcgcagagggcggaggcggcggcggccgcggacccgggagtgtggcactggtgggtacagggcccggggaccccgagctgctcacgctcaaggcggtccgggctatcgaggcggcggacctggtgctctacgacaggcttgtgtctaacgacgtgttggacttggtcggggagggctccaggctgcgctatgtcggcaagaccgcgggataccacagccgcacccaggaggagattcacgagctgctgctgagctttgcggaggctggtgccaatgttgtgcgcttgaaaggtggcgatcctctggtttttggaaggggtggagaagagatggatttcttacagcaacagggaatcaaagttgaaattatcccaggaattacctctgcttcaggaattgcagcagaactaggcattccgctaacccatcgaggtgttgctaccagtgtcagatttttaactggacactccagaaatggtgggacagacccactatatgtagctggaaatgcagccgatcctgacactactttggttgtgtacatgggtttgtcaacacttgcatcacttgcaccaaagttaatgaagcacggcctgccaccagatacccctgctgttgcagtagagcgcgggactacacctcaacaacgaatggtgttcgcgttgttaaaggatcttgtggatgaagtcaagtcagctgatcttgtttctccaactctaataattatcgggaaagtggtatccttgtcaccattttgggttgagtcatctgaacatgatgccctgaaaattgagagctcgtatgcaagtgaagccagatgataatacgttttcatgattttagtgatcggacaatacatacttgagtatcgcaatatcccagatatgagcagttcgagttgggatccatttaggacatgcgagcacaggttcgacctggtgtacacaacatttcaggaagcatggattctgaatgacggatgatagcttaagcccataacagcctttggggtttgggcagaagcgcacttgggagttgatgagggcatgtctggaggcttcagcttcagtaaatttacggctttcaattcggtgtcttcttcgtcaaagaagactcggtagatgtatggttttcaattcaatagcacctgcaaactcctttctgactggaggtccattcggagtgcagggattttacagaaattagacaaaaaaagttctgttttttggggggaattagaaaaatctctgcttcccaagcgtagataactgtaagatttttgttgtcatctttaaaataattgtattgtttttatgtgttatattcatctttaaaaactctggtaaaacagagcctgaagaatgaacctttagctaaaaaaaaaaaaaaa

SEQ ID NO: 308 - protein, 389 aa, Zea mays
MALAVRTPRFQPRPASISAPATPASNSLAAAAAANARPRTCAGAAVRASPFTEATSSSRYLRDAWSYATDCSSNSASRSSDAAAAAAALGRRDDEIALQLPELQRLLDALRASRRRGAEGGGGGGRGPGSVALVGTGPGDPELLTLKAVRAIEAADLVLYDRLVSNDVLDLVGEGSRLRYVGKTAGYHSRTQEEIHELLLSFAEAGANVVRLKGGDPLVFGRGGEEMDFLQQQGIKVEIIPGITSASGIAAELGIPLTHRGVATSVRFLTGHSRNGGTDPLYVAGNAADPDTTLVVYMGLSTLASLAPKLMKHGLPPDTPAVAVERGTTPQQRMVFALLKDLVDEVKSADLVSPTLIIIGKVVSLSPFWVESSEHDALKIESSYASEAR

SEQ ID NO: 309 - DNA, 1607 bp, Zea mays
cgcttcgacaaaacctccaatacacacacacacctccgttcctccctcacgccggcggcctgtatccctctccccatggctgctggactgggagcgcgcccctccgccaccttcgtggccggaaggttccggcctctcgctgcccctctccgccccgtccgctccggcaagttcgttgtgccaaagcgatgcttcattgtatcaagcaggcttgcatgggtggaagatgagcttatggagatacaaaagtcacaagagcaaagttcagtaaaatcaaagaaaaggccacctttgaggcgtggaaaggtctccccacaacttcctgtaccagggcacattccaagaccatcttatgttggtgcgaaaggattgcctgaactatgcaagggccaattacatgatgctcaaggaattactggaatgagagctgcttgcaaacttgctgcccgtgttcttgacttcgctgggactttagttaagccatccattactacaaatgaaattgacgcagcagtccataatatgatcattgaggctggtgcttatccttctccacttggctatcatggatttcctaagagtatatgtacatcagtaaatgagtgtgtctgtcatggggtacctgattcaactcagctgcagaatggggatattataaatattgatgtaaatgtgttcctgaatggataccatgggggtacctccagaacatttgcatgtggacaagtggatgattctatcaaacattttctcaatgcagctgaagaatgcttggagaaaggcatttctatctgcagggatggtgtgaactacagaaagattggcaagaaaataagcaagcttgcctatttttatggctattatgtggtggaacgctttgttgggcatgggattggaactatgtatcattctgagccactaattctacatcatgccaacgaaaactcagggcgtatggttgagggccaaacatttacaattgaacctatactcacaatggagaaaacagagtgtgttacatgggaagatggatggacgactgtcactgctgatggtagctgggctgcgcagtttgagcataccatactggtgactagggacggtgcagaaatactgacgaaagtttgagctattctcctgcccgataattcttgtcagaactctcagctatggttcctgtcccaagtcatcctggtcatgtccgttgctcgtcgcaatgctcatttcagagttttgagatctgctgcaggccgacatacgggaaaggtttcccccatgtagcagcaacttgcaggtgataggtgagggcacacacacacacagacacggctgcatctctgtgattaacacattgctggtctcctgcagcctgctgtagtggtgttgctgggggatgtcgtgcctttggattctagaagacattctgtatataaaacagcactgctaacagttcagtctagaacttagaagtagaaactgttattgttatgatacggaagcactttaggggaacagttggagacacatttttatgtttttcaaaaaaaaaatgatttagaaaagacttatagggagctcttggaaatgctttaataaaaacatctcct

SEQ ID NO: 310 - protein, 350 aa, Zea mays
MAAGLGARPSATFVAGRFRPLAAPLRPVRSGKFVVPKRCFIVSSRLAWVEDELMEIQKSQEQSSVKSKKRPPLRRGKVSPQLPVPGHIPRPSYVGAKGLPELCKGQLHDAQGITGMRAACKLAARVLDFAGTLVKPSITTNEIDAAVHNMIIEAGAYPSPLGYHGFPKSICTSVNECVCHGVPDSTQLQNGDIINIDVNVFLNGYHGGTSRTFACGQVDDSIKHFLNAAEECLEKGISICRDGVNYRKIGKKISKLAYFYGYYVVERFVGHGIGTMYHSEPLILHHANENSGRMVEGQTFTIEPILTMEKTECVTWEDGWTTVTADGSWAAQFEHTILVTRDGAEILTKV

SEQ ID NO: 311 - DNA, 1638 bp, Zea mays
atgtcgtcgtcagcggcggcgcaggggacggagcacgaggctgacgcgtggtacgcggtaccgggcctcagcctccgcgaccaccggttcgccgtcccgcttgaccactccagtcccgagcgcggggacaccatcaccgtcttcgcgcgcgaggtcgtcgccgctgggaaagaatacatatctctgccttatttattgtacctacaaggagggcctggatttgagagtccccgtcccacggaagcaggtgggtggttaaagaaagcttgtgaagaccaccgcgttgtcctgctagatcagcggggaacaggattatccacaccgttgactccatcatctctttcgcaaattaaatctcctgcaaatcaggtggagtacctgaagcatttcagggcagataatatagttaaggatgcagaatttattcgtgtacgtcttgtaccagatgctaagccttggacagtcctaggacagagttatggtggattttgtgccgttacatatttgagttttgctccagaaggcctgaaatctgttcttttgactggagggctcccaccactaggagaaccttgcactgcagatacggtgtacagagcttgctttaaacaggtccagcagcaaaacgagaagtactataagaggtacccccaagatatacaggtcgttcatgaggttataagatacttaagtgaatctgaagggggaggggttcttcttccatctggtggccggttaacccctaagatgctgcagtgtcttggattatcaggtctaggttttggtggtggatttgaaaggctgcattatctgcttgagagggtgtgggatcctgtacttgtcgctggagctaaaaagaggataagctattacttcttaaaagagttcgaaatgtggctagattttgatcaaaatcctctttatgccctcttgcacgagtctatctactgtgagggctcttcatcaaaatggtctgctgaaaagattcatggcgaatatgggagtttgtttgaccctattaaagctacagaagaaggccgagctgtgtactttactggagagatggtgttcccttgcatgttcgatgacatccctgctctacgagacctaaaggaggctgcctgtttgttagctgagaaggaagactggcctccgctctatgatgtcagcgtgttgaacaacaataaggttccggtagcggctgcggtgtactacgaggacatgttcgttaacttcaacatcgccaaggagaccgcctcccagattgctgggatccggctctgggtgaccaacgagtacatgcactcgggcatccgcgacggcggctcgcacgtctttgagtatctcatggctcttctgaacggcaagaagcctttgttttagctgtttcagaagccctgctatctaggttcgagtgtcagttgagctgaacctactatgattgaaacgagcaaataatgaggtccgtttggtttcatgaacaaacgaataatgtttaccttgtagaaatttcacggataatgtataacgttttgaaatttggtccgcagctacatcatagaaatggaattggtctgctcgcaagacacgttccgagcagtactatgaaacaaaaaaaaaaaaaaaaaaaaaaaaaaa

SEQ ID NO: 312 - protein, 460 aa, Zea mays
MSSSAAAQGTEHEADAWYAVPGLSLRDHRFAVPLDHSSPERGDTITVFAREVVAAGKEYISLPYLLYLQGGPGFESPRPTEAGGWLKKACEDHRVVLLDQRGTGLSTPLTPSSLSQIKSPANQVEYLKHFRADNIVKDAEFIRVRLVPDAKPWTVLGQSYGGFCAVTYLSFAPEGLKSVLLTGGLPPLGEPCTADTVYRACFKQVQQQNEKYYKRYPQDIQVVHEVIRYLSESEGGGVLLPSGGRLTPKMLQCLGLSGLGFGGGFERLHYLLERVWDPVLVAGAKKRISYYFLKEFEMWLDFDQNPLYALLHESIYCEGSSSKWSAEKIHGEYGSLFDPIKATEEGRAVYFTGEMVFPCMFDDIPALRDLKEAACLLAEKEDWPPLYDVSVLNNNKVPVAAAVYYEDMFVNFNIAKETASQIAGIRLWVTNEYMHSGIRDGGSHVFEYLMALLNGKKPLF

SEQ ID NO: 313 - DNA, 2099 bp, Zea mays
ggcacatcactagctagtacagaaaatggagcaggccggtgacgagacgccgggagagatcgggcgagaggctgctcgccgtgaagctgcgctccggagcggcggcggagacgccggagagcgcgtagacaaggctgtggtggacggcggagaagacgagcggtttcgcgtgcagcggaaatggaggcggttcttggcccatgtcgggcccggagctctcgtggccattggcttcctggatcctagcaacttggaaaccgacatgcaagctggggctgacttcaagtaccagcttctgtgggtgattttagtcgggatggtcttcgcgcttctgatccaaacactggccgccaaccttggagtgaagacaggcaagcatctcgctgagctctgcagggaagagtacccacgttccgtcaacatctgcctgtggatcatcgcggagctggcggtgatatccgacgacatccccgaaggttgctgatcgattaggcaatcagctagctagctagcttccttcctcctcgagttcttcttcttctccttcttcttcctgtcatcctgtacgtgtgtgtgctctaaacgatgcccagctacctttggtttcactttcacctaccgcagtgctgggcacagccttcgcgttcaacatcctgctcgggatcccggtgtgggccggagtcgtcctcacggtgctcagcacgctgctgctcctcggggtggagagattcggggcccgcaagctggagttcgtcgtggcagctttcatgttcgccatggcggcctgcttcttcggggagctgagctacctgaggccgtccgcgggggaggttgtcgagggcatgttcgtccccaggctccgagggaaaggcgcggcagccaacgccatcgcgctcttcggcgccatcatcacgccgtacaacctgttcctgcactcggcgcttgtgctctccaggaagaccccgcggtcagtgaaaagcatcagggccgcgtgcaggtacttcctcgtggagtgcagcctggcgttcgtggtggcgttcctcatcaacgtggcggtggtcgtcgtcgccgggtccatctgcaacgcggcgggcggcaacctgtccccggccgacgcggccgcgtgcggcgacctcactctgcagtccacgcctctgctgctcagggacgttctggggaggtcgagctccgtcgtgtacgccgtcgcgctgctggcgtccgggcagagcaccaccatcagctgcacgtttgccgggcaggttatcatgcaggggttcctggacatgaggatgaagagctgggtgcggaacctgaccacgcgcgccatcgccatcgcccccagcctcgtcgtctccatcgtcagcggcccgtcgggtgctggcaagctcatcgtcttctcgtcgatggtgctgtcgttcgagctgccattcgcgctcatcccgctcctcaagttctgcaacagcagcaacaaagtcgggcccctcaaggagtccatctacacggtggtgatcgcgtgggcgctgagcttcgcgctcatcgtggtgaacacctacttcctggtgtggacgtacgtggactggctggtgcacagtcggctccccaagtacgccaccgcgctcctctccgtcgccgtcctggcgctcatggccgcctacctcgccttcgtcgtctacctggcgttcaggagggacgcggtgcgcacgtacgtgccggtgtcggagcgggcggaggacggcagcgggtcgcaggcggtggcggcggcggcctccgccgacgacgctgacatgccggcgccgttcaggaaggacctggctgatgcttccacgtagacacggagatgctctcgttcgggcagtgaccatatcgatcaatcctgttcatgcatatgatttgtggatcgtcgtcgagaggcgtgctggctcattcgtctgctcagtgaccgaatttgttcgtgtacgtagattatcataagatcttacacgcagccgcataccaagccacacgaaccttcgtgtacggttttgatatatcccatatccaacagttcatccatgttttacaatatagataatattattcgcaaaaaaaaaaaaaaaaaa

SEQ ID NO: 314 - protein, 2099 aa, Zea mays
GGCACATCACTAGCTAGTACAGAAAATGGAGCAGGCCGGTGACGAGACGCCGGGAGAGATCGGGCGAGAGGCTGCTCGCCGTGAAGCTGCGCTCCGGAGCGGCGGCGGAGACGCCGGAGAGCGCGTAGACAAGGCTGTGGTGGACGGCGGAGAAGACGAGCGGTTTCGCGTGCAGCGGAAATGGAGGCGGTTCTTGGCCCATGTCGGGCCCGGAGCTCTCGTGGCCATTGGCTTCCTGGATCCTAGCAACTTGGAAACCGACATGCAAGCTGGGGCTGACTTCAAGTACCAGCTTCTGTGGGTGATTTTAGTCGGGATGGTCTTCGCGCTTCTGATCCAAACACTGGCCGCCAACCTTGGAGTGAAGACAGGCAAGCATCTCGCTGAGCTCTGCAGGGAAGAGTACCCACGTTCCGTCAACATCTGCCTGTGGATCATCGCGGAGCTGGCGGTGATATCCGACGACATCCCCGAAGGTTGCTGATCGATTAGGCAATCAGCTAGCTAGCTAGCTTCCTTCCTCCTCGAGTTCTTCTTCTTCTCCTTCTTCTTCCTGTCATCCTGTACGTGTGTGTGCTCTAAACGATGCCCAGCTACCTTTGGTTTCACTTTCACCTACCGCAGTGCTGGGCACAGCCTTCGCGTTCAACATCCTGCTCGGGATCCCGGTGTGGGCCGGAGTCGTCCTCACGGTGCTCAGCACGCTGCTGCTCCTCGGGGTGGAGAGATTCGGGGCCCGCAAGCTGGAGTTCGTCGTGGCAGCTTTCATGTTCGCCATGGCGGCCTGCTTCTTCGGGGAGCTGAGCTACCTGAGGCCGTCCGCGGGGGAGGTTGTCGAGGGCATGTTCGTCCCCAGGCTCCGAGGGAAAGGCGCGGCAGCCAACGCCATCGCGCTCTTCGGCGCCATCATCACGCCGTACAACCTGTTCCTGCACTCGGCGCTTGTGCTCTCCAGGAAGACCCCGCGGTCAGTGAAAAGCATCAGGGCCGCGTGCAGGTACTTCCTCGTGGAGTGCAGCCTGGCGTTCGTGGTGGCGTTCCTCATCAACGTGGCGGTGGTCGTCGTCGCCGGGTCCATCTGCAACGCGGCGGGCGGCAACCTGTCCCCGGCCGACGCGGCCGCGTGCGGCGACCTCACTCTGCAGTCCACGCCTCTGCTGCTCAGGGACGTTCTGGGGAGGTCGAGCTCCGTCGTGTACGCCGTCGCGCTGCTGGCGTCCGGGCAGAGCACCACCATCAGCTGCACGTTTGCCGGGCAGGTTATCATGCAGGGGTTCCTGGACATGAGGATGAAGAGCTGGGTGCGGAACCTGACCACGCGCGCCATCGCCATCGCCCCCAGCCTCGTCGTCTCCATCGTCAGCGGCCCGTCGGGTGCTGGCAAGCTCATCGTCTTCTCGTCGATGGTGCTGTCGTTCGAGCTGCCATTCGCGCTCATCCCGCTCCTCAAGTTCTGCAACAGCAGCAACAAAGTCGGGCCCCTCAAGGAGTCCATCTACACGGTGGTGATCGCGTGGGCGCTGAGCTTCGCGCTCATCGTGGTGAACACCTACTTCCTGGTGTGGACGTACGTGGACTGGCTGGTGCACAGTCGGCTCCCCAAGTACGCCACCGCGCTCCTCTCCGTCGCCGTCCTGGCGCTCATGGCCGCCTACCTCGCCTTCGTCGTCTACCTGGCGTTCAGGAGGGACGCGGTGCGCACGTACGTGCCGGTGTCGGAGCGGGCGGAGGACGGCAGCGGGTCGCAGGCGGTGGCGGCGGCGGCCTCCGCCGACGACGCTGACATGCCGGCGCCGTTCAGGAAGGACCTGGCTGATGCTTCCACGTAGACACGGAGATGCTCTCGTTCGGGCAGTGACCATATCGATCAATCCTGTTCATGCATATGATTTGTGGATCGTCGTCGAGAGGCGTGCTGGCTCATTCGTCTGCTCAGTGACCGAATTTGTTCGTGTACGTAGATTATCATAAGATCTTACACGCAGCCGCATACCAAGCCACACGAACCTTCGTGTACGGTTTTGATATATCCCATATCCAACAGTTCATCCATGTTTTACAATATAGATAATATTATTCGCAAAAAAAAAAAAAAAAAA

What is claimed is:

1. An isolated polynucleotide selected from the group consisting of:
   a. a polynucleotide consisting of SEQ ID NO: 13; wherein the polynucleotide encodes a polypeptide having ferredoxin NADP+ reductase activity; and
   b. a polynucleotide which is fully complementary to the polynucleotide of (a).

2. A recombinant expression cassette, comprising the polynucleotide of claim 1, wherein the polynucleotide is operably linked, in sense orientation, to a promoter.

3. A host cell comprising the expression cassette of claim 2.

4. A transgenic plant comprising the recombinant expression cassette of claim 2.

5. The transgenic plant of claim 4, wherein said plant is a monocot.

6. The transgenic plant of claim 4, wherein said plant is a dicot.

7. The transgenic plant of claim 4, wherein said plant is selected from the group consisting of: maize, soybean, sunflower, sorghum, canola, wheat, alfalfa, cotton, rice, barley, millet, peanut and cocoa.

8. A transgenic seed from the transgenic plant of claim 4.

9. The transgenic plant of claim 4, wherein the ferredoxin NADP+ reductase activity in said plant is increased as compared to a non transformed plant.

10. The transgenic plant of claim 9, wherein the plant has enhanced root growth as compared to a non transformed plant.

11. The transgenic plant of claim 9, wherein the plant has increased seed size as compared to a non transformed plant.

12. The transgenic plant of claim 9, wherein the plant has increased seed weight as compared to a non transformed plant.

13. The transgenic plant of claim 9, wherein the plant has seed with increased embryo size as compared to a non transformed plant.

14. The transgenic plant of claim 9, wherein the plant has increased leaf size as compared to a non transformed plant.

15. The transgenic plant of claim 9, wherein the plant has increased seedling vigor.

16. The transgenic plant of claim 9, wherein the plant has enhanced silk emergence as compared to a non transformed plant.

17. The transgenic plant of claim 9, wherein the plant has increased ear size as compared to a non transformed plant.

* * * * *